(12) United States Patent
Chiapelli et al.

(10) Patent No.: US 8,907,162 B2
(45) Date of Patent: Dec. 9, 2014

(54) COMPOSITIONS AND METHODS FOR THE CONTROL OF ROOT LESION NEMATODE

(75) Inventors: Brandi Chiapelli, St. Louis, MO (US); Matt W. Dimmic, Wildwood, MO (US); Deryck Jeremy Williams, University City, MO (US); Jennifer Sheppard, St. Louis, MO (US); John D. Bradley, St. Louis, MO (US); Carl Diehl, St. Louis, MO (US); Michelle L. Gasper, St. Charles, MO (US); Bingli Gao, St. Louis, MO (US); James P. McCarter, St. Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 13/519,929

(22) PCT Filed: Dec. 29, 2010

(86) PCT No.: PCT/US2010/062338
§ 371 (c)(1),
(2), (4) Date: Oct. 23, 2012

(87) PCT Pub. No.: WO2011/082217
PCT Pub. Date: Jul. 7, 2011

(65) Prior Publication Data
US 2013/0036519 A1    Feb. 7, 2013

Related U.S. Application Data

(60) Provisional application No. 61/291,064, filed on Dec. 30, 2009.

(51) Int. Cl.
| | |
|---|---|
| C12N 15/82 | (2006.01) |
| C12N 15/00 | (2006.01) |
| A01H 5/00 | (2006.01) |
| C07H 21/04 | (2006.01) |
| A23K 1/00 | (2006.01) |

(52) U.S. Cl.
USPC ........ 800/285; 435/320.1; 435/419; 800/295; 800/279; 800/301; 426/655

(58) Field of Classification Search
None
See application file for complete search history.

(56) References Cited

U.S. PATENT DOCUMENTS

| | | |
|---|---|---|
| 2004/0098761 A1 | 5/2004 | Trick et al. |
| 2004/0185566 A1 | 9/2004 | Salamone |
| 2007/0250947 A1 | 10/2007 | Boukharov et al. |
| 2007/0271630 A1 | 11/2007 | Boukharov et al. |

FOREIGN PATENT DOCUMENTS

| | | | |
|---|---|---|---|
| WO | WO 2007095469 A2 * | 8/2007 | ........... C07K 14/435 |
| WO | 2007/104570 A2 | 9/2007 | |
| WO | 2008/110522 A1 | 9/2008 | |
| WO | 2009/126896 A2 | 10/2009 | |

OTHER PUBLICATIONS

Cha et al, 2012, Gene Expression Patterns, 12:189-195.*

* cited by examiner

*Primary Examiner* — David H Kruse
*Assistant Examiner* — Jason Deveau Rosen
(74) *Attorney, Agent, or Firm* — Thompson Coburn LLP; J. Wendy Davis

(57) ABSTRACT

The present invention discloses gene targets, constructs and methods for the genetic control of plant disease caused by nematodes of the genus *Pratylenchus* (root lesion nematodes). The present invention relates to achieving a plant protective effect through the identification of target coding sequences and the use of recombinant DNA technologies for post-transcriptionally repressing or inhibiting expression of the target coding sequences in the cells of plant-parasitic nematodes. The disclosed gene targets are conserved and expected to be essential and sensitive to RNAi perturbation in different *Pratylenchus* species, facilitating genus-wide targeting by RNA interference.

21 Claims, 4 Drawing Sheets

COMPOSITIONS AND METHODS FOR THE CONTROL OF ROOT LESION NEMATODE

CROSS-REFERENCE TO RELATED APPLICATIONS

This application is a 35 U.S.C. §371 application of International Patent Application No. PCT/US2010/062338, filed Dec. 29, 2010 and incorporated herein by reference in its entirety, which claims the benefit under 35 U.S.C. §119 of U.S. Provisional Patent Application No. 61/291,064, filed Dec. 30, 2009 and incorporated herein by reference in its entirety.

INCORPORATION OF SEQUENCE LISTING

A Sequence Listing is contained in the file named "58526_B.txt" which is 4,176,446 bytes (measured in MS-Windows) and was created on Jun. 27, 2012. This electronic Sequence Listing is electronically filed herewith and is incorporated herein by reference.

BACKGROUND OF THE INVENTION

1. Field of the Invention

The present invention discloses gene targets, constructs and methods for the genetic control of plant disease caused by plant-parasitic nematodes—specifically nematodes of the genus *Pratylenchus* known as root lesion nematodes. More specifically, the present invention relates to achieving plant protective effects through the identification of target coding sequences and the use of recombinant DNA technologies, to provide specific dsRNA sequences in the nematode diet, for post-transcriptionally repressing or inhibiting expression of the target coding sequences in the cells of plant-parasitic nematodes to provide plant protection. The gene targets disclosed in this invention are excellent candidates for generating robust protection against multiple *Pratylenchus* species via RNA interference methods. There is nonetheless sufficient nucleotide divergence to avoid cross reactivity with plant orthologs and to provide selectivity to other non-target organism such as mammals and beneficial insect species such as bee pollinators.

2. Description of Related Art

Plants are subject to multiple disease causing agents, including plant-parasitic nematodes, which are active, flexible, elongate organisms that live on moist surfaces or in liquid environments, including films of water within soil and moist tissues within other organisms. Nematodes grow through a series of lifecycle stages and molts. Typically, there are five stages and four molts: egg stage; J1 (i.e. first juvenile stage); M1 (i.e. first molt); J2 (second juvenile stage; sometimes hatch from egg); M2; J3; M3; J4; M4; A (adult). Juvenile ("J") stages are also sometimes referred to as larval ("L") stages.

Both plant-specific and animal-specific species of nematodes have evolved as very successful parasites and are responsible for significant economic losses in agriculture and livestock production and for morbidity and mortality in humans. Nematode parasites of plants can inhabit all parts of plants, including roots, developing flower buds, leaves, and stems. There are numerous plant-parasitic nematode species, including various lesion nematodes (i.e. *Pratylenchus* spp.), root knot nematodes (i.e. *Meloidogyne* spp.), cyst nematodes (i.e. *Heterodera* spp.), dagger nematodes (i.e. *Xiphinema* spp.) and stem and bulb nematodes (i.e. *Ditylenchus* spp.), among others. However, the largest and most economically important groups of plant-parasitic nematodes are the families Pratylenchidae (lesion nematodes), Meloidogynidae (root knot nematodes) and Heteroderidae (cyst nematodes) with lesion and root knot nematodes being particularly noteworthy for their very broad host rages. Plant parasitic nematodes are classified on the basis of their feeding habits into the broad categories of migratory ectoparasites, migratory endoparasites, and sedentary endoparasites. Sedentary endoparasites, which include the root knot nematodes (*Meloidogyne* spp.) and cyst nematodes (*Globodera* and *Heterodera* spp.) induce feeding sites ("giant cells" in the case of root knot nematodes and "syncytia" for cyst nematodes) and establish long-term infections within roots. In contrast, while spending most of their lifecycles within host tissues, migratory endoparasitic nematodes like lesion neamtodes (*Pratylenchus* spp.) do not induce permanent feeding sites but feed while migrating between or through plant cells. It is estimated that parasitic nematodes cost the horticulture and agriculture industries in excess of $78 billion worldwide a year, based on an estimated average 12% annual loss spread across all major crops. For example, it is estimated that nematodes annually cause soybean losses of approximately $3.2 billion worldwide (Barker et al., 1994).

Traditional approaches to control plant diseases have relied on crop rotation, chemical treatment and the construction of interspecific hybrids between resistant crops and their wild-type relatives as sources of resistant germplasm. However these traditional approaches all suffer from significant limitations for root lesion nematode control. For example, genetic resistance to lesion nematodes is usually narrow spectrum (e.g., resistance or tolerance to *P. thornei* in wheat is rarely accompanied by resistance to *P. neglectus*) whereas multiple species of lesion nematode are typically present in fields where crops are grown. In addition, most chemical nematode control agents are not effective in eradicating nematode infestations as nematodes inside roots are largely protected. The few agents like fumigant methyl bromide that can effectively get to nematode reservoirs are biocides effectively sterilizing a field for a period of time over which the nematode control agent has been applied. In addition, the most widely used fumigant nematicide, methyl bromide, is scheduled to be soon retired from use, and at present, there is no promising candidate to replace this treatment. The non-fumigant organophosphates and carbamates nematicides like ethoprop, terbufos, carbofuran and aldicarb though not as broad spectrum also show poor selectivity. In particular these chemical nematode control agents are highly toxic to mammals, birds, fish, and to non-target beneficial insects. These agents can in some cases accumulate in the water table or the food chain, and in higher trophic level species. These agents may also act as mutagens and/or carcinogens to cause irreversible and deleterious genetic modifications. As a result, government restrictions have been imposed on the use of these chemicals. Additionally, few chemical nematicides (fumigant or non-fumigant) are cost effective for use in large acreage row crops such as soybeans and corn. Chemical seed treatments can be economically applied in large acreage control crops but these only provide early season protection under moderate levels of nematode infestation. Finally, crop rotation or fallowing without weeding is not an effective strategy for controlling root lesion nematodes because of their broad host ranges which includes most crops, native grasses and weeds.

Consequently, alternative methods for nematode control, such as genetic methods, are increasingly being studied. An environmentally benign but effective alternative for controlling lesion nematodes is the use of RNA interference against essential nematode genes to control nematode infestation of plants. This is achieved through the transgenic expression of double stranded RNA (dsRNA) in plants complementary to target nematode genes. It was first demonstrated in the free living nematode *Caenorhabditis elegans* that dsRNA could be provided in the diet either through expression in bacterial food source or through soaking in dsRNA containing solutions and effect suppression of the genes function in the nematodes (Fire et al. 1998 Nature 391(6669):806-11, Fire et al. U.S. Pat. No. 6,506,559). RNA interference ("RNAi") utilizes endogenous cellular pathways whereby a double stranded RNA (dsRNA) specific target gene results in the degradation of the mRNA of interest or diminished translation of protein from the mRNA template. The effector proteins of the RNAi pathway include the Dicer protein complex that generates ~21-nucleotide small interfering RNAs (siRNAs) from the original dsRNA and the RNA-induced silencing complex (RISC) that uses siRNA guides to recognize and degrade or block translation from the corresponding mRNAs. Only transcripts complementary to the siRNAs are affected, and thus the knock-down of mRNA expression is usually sequence specific. In some systems the initial dsRNA trigger or siRNA effectors can be amplified by RNA Directed RNA Polymerases (RDRPs) in an mRNA template dependent manner which can lead to the production of secondary siRNAs both within and outside the initial trigger dsRNA. The gene silencing effect of RNAi can persist for days and, under experimental conditions, can in some cases lead to a decline in abundance of the targeted transcript of 90% or more, with consequent decline in levels of the corresponding protein. Protein levels can also be perturbed by blocking translation without significantly affecting mRNA transcript levels.

Recent reports suggest that such an approach may have potential for the control of plant parasitic nematodes (Steeves et al. 2006 Funct Plant Biol. 33(11): 991-999; Huang et al. 2006 Proc Natl Acad Sci USA. 103(39):14302-6; Yadav et al. 2006 Mol Biochem Parasitol. 148(2):219-22). However the selection of the gene target and the choice of promoter to drive the dsRNA are both crucial and not easy to predict a priori (Fairbairn et al. 2007 *Planta* 226(6):1525-33). Additionally to be most effective the dsRNAs must not cause yield drag due to phytotoxicity from unfavorable off target effects in the plant host. This invention discloses gene targets in *Pratylenchus* species which are suitable for providing genus wide, durable, commercial levels of nematode resistance through RNAi-based approaches without untoward effects to the host plant or non-target organisms.

SUMMARY OF THE INVENTION

Figure 1:
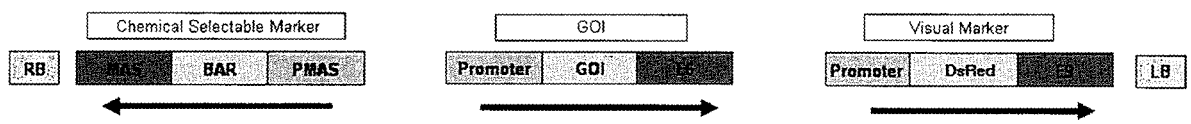
FIG. 1 shows a schematic example of the typical hairy root expression construct used to select for combined chemical (basta) and fluorescence (DsRed) to produce hairy roots with uniform expression of a nematicidal gene of interest (GOI).
Figure 2:
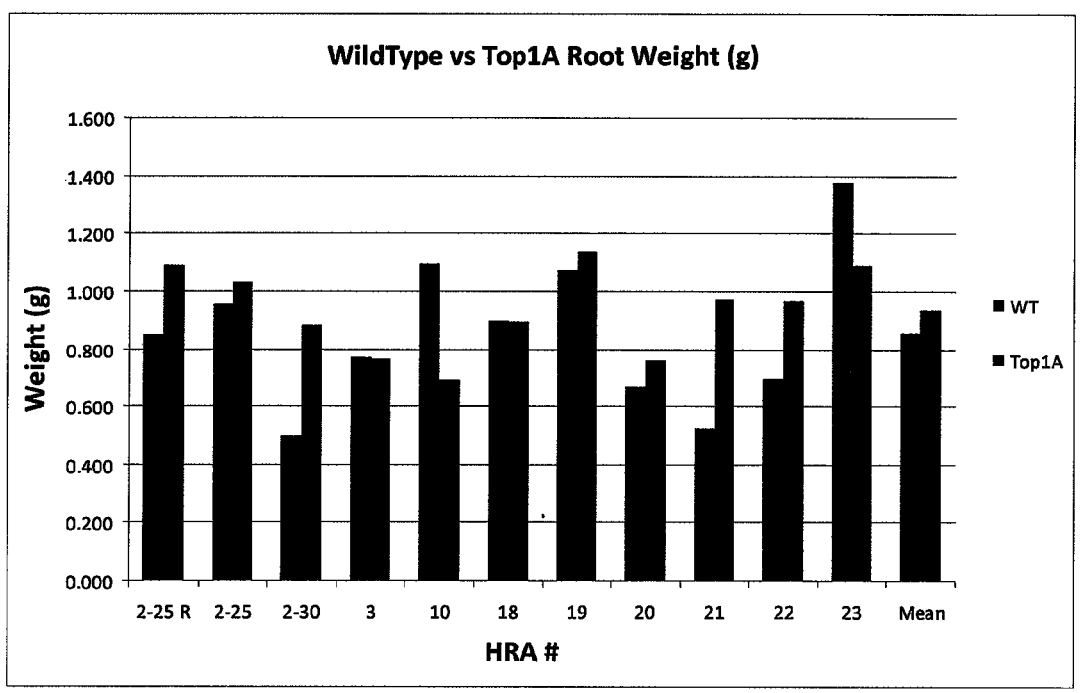
FIG. 2. A protective root weight enhancement (relative to the wild type control) is seen in tomato hairy roots expressing top1 dsRNA targeting the *Pratylenchus scribneri* top1 gene when infected with lesion nematodes.
Figure 3:
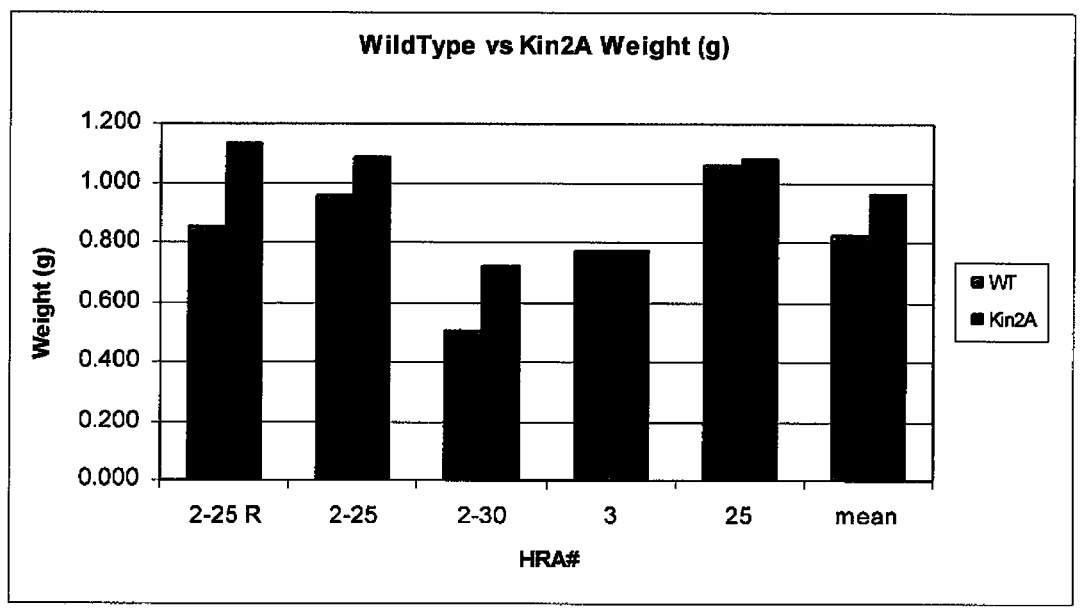
FIG. 3. A protective root weight enhancement (relative to the wild type control) is seen in tomato hairy roots expressing kin2 dsRNA targeting the *Pratylenchus scribneri* kin2 gene when infected with lesion nematodes.
Figure 4:
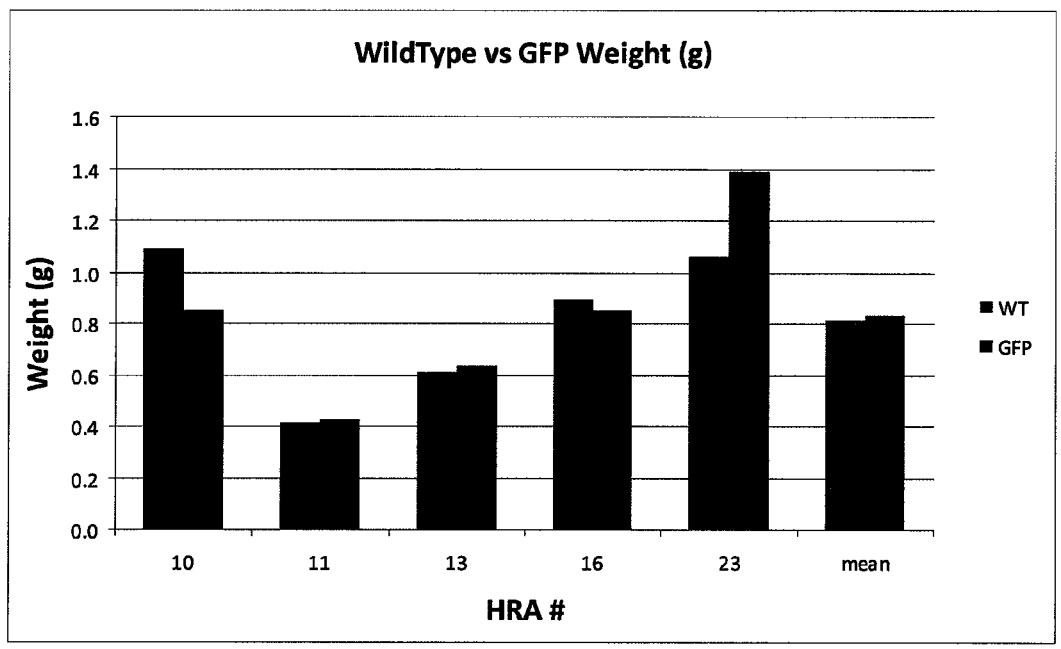
FIG. 4. No protective root weight enhancement (relative to the wild type control) is seen in tomato hairy roots expressing the GFP control dsRNA when infected with lesion nematodes.

In one aspect, the present invention comprises an isolated polynucleotide selected from the group consisting of: (a) a fragment of at least 17, 18, 19, 20 or 21 contiguous nucleotides of a nucleic acid sequence of any of: SEQ ID NO:1-51 or SEQ ID NO:120-1064, wherein uptake by a plant-parasitic nematode of a double stranded ribonucleotide sequence comprising at least one strand that is complementary to said fragment inhibits the growth of the nematode; and (b) a complement of the sequence of (a). The invention also includes a polynucleotide comprising: (a) a first polynucleotide sequence comprising at least 17, 18, 19, 20 or 21 contiguous nucleotides of a nucleic acid sequence of any of: SEQ ID NO:1-51 or SEQ ID NO:120-1064; and (b) a second polynucleotide sequence comprising the reverse complement of the least 17, 18, 19, 20 or 21 contiguous nucleotides of a nucleic acid sequence of any of: SEQ ID NO:1-51 or SEQ ID NO:120-1064. In some cases a spacer nucleotide sequence of between 4 and 300 (e.g., 4-50, 4-100, 4-150, 50-200, 50-300) nucleotides is located between the first nucleotide sequence and the second nucletode sequence. Such a spacer nucleotide sequence can form a single-stranded loop when the first nucleotide sequence is base-paired to the second nucleotide sequence, forming a double stranded region. In some cases, the second polynucleotide sequence comprises a subsequence of at least 25 (35, 40, 50, 60, 70, 80, 90, 100, 150 or more) nucleotides which is the reverse complement of a subsequence within the first polynucleotide sequence. Thus, in some cases, the 17, 18, 19, 20 or 21 contiguous nucleotides of a nucleic acid sequence of any of: SEQ ID NO:1-51 or SEQ ID NO:120-1064 is contained within a subsequence of the first nucleotide sequence and the reverse complement of the least 17, 18, 19, 20 or 21 contiguous nucleotides of a nucleic acid sequence of any of: SEQ ID NO:1-51 or SEQ ID NO:120-1064 is contained within a subsequence of the second nucleotide sequence and the subsequence of the second nucleotide sequence is the reverse complement of the subsequence of the first nucleotide sequence. Thus, the polynucleotide can form a molecule having a double stranded region of 20, 30, 40, 50, 60, 70, 80, 90, 100 or more base-pairs.

In certain embodiments, the isolated polynucleotide is defined as operably linked to a heterologous promoter. By "heterologous" is meant any sequence, e.g. promoter, which is not naturally found joined to the polynucleotide, including, for example, a combination of nucleic acid sequences from the same plant which are not naturally found joined together. In certain embodiments the isolated polynucleotide is comprised on a plant transformation vector.

Another aspect of the invention is a double stranded ribonucleotide sequence produced from the expression of such a polynucleotide, wherein the taking up of the ribonucleotide sequence by a plant-parasitic nematode inhibits the growth of the nematode. In certain embodiments the double stranded ribonucleotide sequence is further defined as produced by preparing a recombinant polynucleotide sequence comprising a first, a second and a third polynucleotide sequence, wherein the first polynucleotide sequence comprises an isolated polynucleotide selected from the group consisting of: (a) a fragment of at least 17, 18, 19, 20 or 21 contiguous nucleotides of a nucleic acid sequence of any of: SEQ ID NO:1-51 or SEQ ID NO:120-1064, wherein uptake by a plant-parasitic nematode of a double stranded ribonucleotide sequence comprising at least one strand that is complementary to said fragment inhibits the growth of the nematode; and (b) a complement of the sequence of (a); and wherein the second polynucleotide sequence is linked to the first polynucleotide sequence by the third polynucleotide sequence, and wherein the second polynucleotide sequence is substantially the reverse complement of the first polynucleotide sequence such that the first and the third polynucleotide sequences hybridize when transcribed into a ribonucleic acid to form the double stranded ribonucleotide molecule that includes a single stranded region which is the third ribonucleotide sequence. In particular embodiments, the double stranded ribonucleotide sequence inhibits the expression of a nucleotide sequence substantially complementary to the polynucleotide sequence, when the polynucleotide sequence is taken up by the plant-parasitic nematode.

Another aspect of the invention is a plant transformation vector comprising a nucleotide sequence selected from the group consisting of: (a) a fragment of at least 17, 18, 19, 20 or 21 contiguous nucleotides of a nucleic acid sequence of any of: SEQ ID NO:1-51 or SEQ ID NO:120-1064, wherein uptake by a plant-parasitic nematode of a double stranded ribonucleotide sequence comprising at least one strand that is complementary to said fragment inhibits the growth of the nematode; and (b) a complement of the sequence of (a); wherein the DNA sequence is operably linked to a heterologous promoter functional in a plant cell. A further embodiment of the invention is a cell transformed with such a polynucleotide. In certain embodiments, the cell is defined as prokaryotic cell, or a eukaryotic cell. In a particular embodiment, the cell is defined as a plant cell.

Another embodiment of the invention relates to a plant transformed with the polynucleotide selected from the group consisting of: (a) a fragment of at least 17, 18, 19, 20 or 21 contiguous nucleotides of a nucleic acid sequence of any of: SEQ ID NO:1-51 or SEQ ID NO:120-1064, wherein uptake by a plant-parasitic nematode of a double stranded ribonucleotide sequence comprising at least one strand that is complementary to said fragment inhibits the growth of the nematode; and (b) a complement of the sequence of (a). The plant, in certain embodiments, is further defined as selected from a crop selected from the group consisting of: corn, wheat, barley, rye, rice, potato, tomato, cucumber, pepper, clover, legume, soybean, pea, alfalfa, sugar cane, sugar beet, tobacco, carrot, cotton, rapeseed (canola), sunflower, safflower, sorghum, strawberry, banana, turf, and an ornamental plant. A seed of such a plant, wherein the seed comprises the polynucleotide, is another embodiment of the invention. In some embodiments, the polynucleotide is expressed in the plant or plant cell, such as a root cell, as a double stranded ribonucleotide sequence. In other embodiments, the plant-parasitic nematode is a *Pratylenchus* spp. In particular embodiments the plant-parasitic nematode is *Pratylenchus scribneri, Pratylenchus hexincisus, Pratylenchus brachyurus, Pratylenchus zeae, Pratylenchus penetrans, Pratylenchus neglectus* and *Pratylenchus crenatus*. In yet other embodiments, the taking up of the plant-parasitic nematode inhibitory amount of the double stranded ribonucleotide sequence inhibits growth or reproduction of the nematode.

Another aspect of the invention is a commodity product produced from a plant comprising a polynucleotide selected from the group consisting of: (a) a fragment of at least 17, 18, 19, 20 or 21 contiguous nucleotides of a nucleic acid sequence of any of: SEQ ID NO:1-51 or SEQ ID NO:120-1064, wherein uptake by a plant-parasitic nematode of a double stranded ribonucleotide sequence comprising at least one strand that is complementary to said fragment inhibits the growth of the nematode; and (b) a complement of the sequence of (a), wherein the commodity product comprises a detectable amount of the polynucleotide or a ribonucleotide expressed therefrom.

Another aspect of the invention is a method for controlling a plant-parasitic nematode population comprising providing an agent comprising a double stranded ribonucleotide sequence that functions upon being taken up by the nematode to inhibit a biological function within the nematode, wherein the agent comprises a nucleotide sequence selected from the group consisting of SEQ ID NO:1-51 and SEQ ID NO:120-1064, and complements thereof.

Yet another aspect of the invention is a method for controlling a plant-parasitic nematode population comprising providing an agent comprising a first polynucleotide sequence that functions upon being taken up by a plant-parasitic nematode to inhibit a biological function within the nematode, wherein the polynucleotide sequence exhibits from about 95 to about 100% nucleotide sequence identity along at least from about 19 to about 25 contiguous nucleotides to a coding sequence derived from the nematode and is hybridized to a second polynucleotide sequence that is complementary to the first polynucleotide sequence, and wherein the coding sequence derived from the nematode is selected from the group consisting of SEQ ID NO:1-51 and SEQ ID NO:120-1064, and the complements thereof. In certain embodiments, the nematode is *Pratylenchus* spp. In particular embodiments the nematode is *Pratylenchus scribneri, Pratylenchus hexincisus, Pratylenchus brachyurus, Pratylenchus zeae, Pratylenchus penetrans, Pratylenchus neglectus* or *Pratylenchus crenatus*.

Another embodiment of the invention is a method for controlling a plant-parasitic nematode population comprising providing in the host plant of a plant-parasitic nematode a transformed plant cell expressing a polynucleotide sequence selected from the group consisting of SEQ ID NO:1-51 and SEQ ID NO:120-1064, a fragment of at least 17, 18, 19, 20 or 21 contiguous nucleotides of any of these polynucleotide sequences, and complements thereof, wherein the polynucleotide is expressed to produce a double stranded ribonucleic acid that functions upon being taken up by the plant-parasitic nematode to inhibit the expression of a target sequence within the nematode and results in decreased growth or reproduction of the nematode or nematode population, relative to growth or reproduction on a host lacking the transformed plant cell. In certain embodiments the nematode exhibits decreased growth following infection of the host plant. Particular embodiments of the method, wherein the target sequence encodes a protein, the predicted function of which is selected from the group consisting of: DNA replication, cell cycle control, transcription, RNA processing, translation, ribosome function, tRNA synthesis, tRNA function, protein trafficking, secretion, protein modification, protein stability, protein degradation, energy production, mitochondrial function, intermediary metabolism, cell structure, signal transduction, endocytosis, ion regulation, egg production, reproduction, and transport, are also a part of the invention. In particular embodiments the nematode is selected from the group consisting of *Pratylenchus* spp. In more particular embodiments the nematode is *Pratylenchus scribneri, Pratylenchus hexincisus, Pratylenchus brachyurus, Pratylenchus zeae, Pratylenchus penetrans, Pratylenchus neglectus* or *Pratylenchus crenatus*. In some embodiments the polynucleotide functions upon being taken up by the plant-parasitic nematode to suppress a gene that performs a function essential for nematode survival, reproduction, or growth, said function being selected from the group consisting of DNA replication, cell cycle control, transcription, RNA processing, translation, ribosome function, tRNA synthesis, tRNA function, protein trafficking, secretion, protein modification, protein stability, protein degradation, energy production, mitochondrial function, intermediary metabolism, cell structure, signal transduction, endocytosis, ion regulation, egg production, and transport.

Another aspect of the invention is a method for reducing the number of root lesion nematode (RLN) feeding nematodes established in the root tissue of a host plant, comprising providing in the host plant of a *Pratylenchus* spp. a transformed plant cell expressing a polynucleotide sequence selected from the group consisting of SEQ ID NO:1-51 and SEQ ID NO:120-1064, a fragment of at least 17, 18, 19, 20 or 21 contiguous nucleotides of any of these polynucleotide sequences, and the complements thereof, wherein the polynucleotide is expressed to produce a double stranded ribonucleic acid that functions upon being taken up by the *Pratylenchus* spp. to inhibit the expression of a target sequence within said nematode and results in a decrease in the number of productively feeding nematodes established, relative to number of feeding nematodes established on a host lacking the transformed plant cell.

Another embodiment of the invention is a method of controlling plant nematode pest infestation in a plant comprising providing in the diet of a plant nematode pest a dsRNA comprising: a) a sense nucleotide sequence; and b) an antisense nucleotide sequence complementary to the sense nucleotide sequence, wherein the sense nucleotide sequence comprises or is complementary to a nucleotide sequence selected from the group consisting of SEQ ID NO:1-51 and SEQ ID NO:120-1064, and the complements thereof. In one embodiment, the diet comprises a plant cell transformed to express the sense and the antisense nucleotide sequence.

The invention also relates to a method for improving the yield of a crop produced from a crop plant subjected to plant-parasitic nematode infection, said method comprising the steps of: a) introducing a polynucleotide as described herein into said crop plant; and b) cultivating the crop plant to allow the expression of said polynucleotide; wherein expression of the polynucleotide inhibits plant-parasitic nematode infection, growth, reproduction, or loss of yield due to plant-parasitic nematode infection. In certain embodiments the crop plant is selected from the group consisting of: corn, wheat, barley, rye, rice, potato, tomato, cucumber, pepper, clover, legume, soybean, pea, alfalfa, sugar cane, sugar beet, tobacco, carrot, cotton, rapeseed (canola), sunflower, safflower, sorghum, strawberry, banana, turf, and ornamental plants. In some embodiments, the expression of the polynucleotide produces an RNA molecule that suppresses at least a first target gene in a plant-parasitic nematode that has contacted a portion of said crop plant, wherein the target gene performs at least one essential function selected from the group consisting of DNA replication, cell cycle control, transcription, RNA processing, translation, ribosome function, tRNA synthesis, tRNA function, protein trafficking, secretion, protein modification, protein stability, protein degradation, energy production, mitochondrial function, intermediary metabolism, cell structure, signal transduction, endocytosis, ion regulation, egg production, reproduction, and transport. In certain embodiments the plant-parasitic nematode is a Tylenchid nematode. In particular embodiments the plant-parasitic nematode is a *Pratylenchus* spp. In even more particular embodiments the plant-parasitic nematode is *Pratylenchus scribneri, Pratylenchus hexincisus, Pratylenchus brachyurus, Pratylenchus zeae, Pratylenchus penetrans, Pratylenchus neglectus* or *Pratylenchus crenatus*.

Another aspect of the invention is a method for improving the osmotic stress tolerance of a crop plant subjected to plant-parasitic nematode infection, said method comprising the steps of, a) introducing a polynucleotide according to claim 1 into said crop plant; b) cultivating the crop plant to allow the expression of said polynucleotide; wherein expression of the polynucleotide improves the osmotic stress tolerance of the crop plant. In some embodiments the osmotic stress tolerance is defined as drought tolerance.

Yet another aspect of the invention is a method of producing a commodity product comprising obtaining a plant comprising at least 17, 18, 19, 20 or 21 contiguous nucleotides of a nucleic acid sequence of any of: SEQ ID NO:1-51 or SEQ ID NO:120-1064, wherein uptake by a plant-parasitic nematode of a double stranded ribonucleotide sequence comprising at least one strand that is complementary to said fragment inhibits the growth of the nematode; and (b) a complement of the sequence of (a); or a part thereof, and preparing a commodity product from the plant or part thereof. The invention also relates to a method of producing food or feed, comprising obtaining such a plant, or a part thereof, and preparing food or feed from said plant or part thereof. In certain embodiments the food or feed is defined as oil, meal, protein, starch, flour or silage.

Yet another aspect of the invention is a method for modulating the expression of a target gene in a plant-parasitic nematode cell, the method comprising: (a) transforming a plant cell with a vector comprising a nucleic acid sequence selected from the group consisting of SEQ ID NO:1-51 and SEQ ID NO:120-1064, and a fragment of at least 17, 18, 19, 20 or 21 contiguous nucleotides of any of these sequences, wherein the nucleic acid sequence encodes a dsRNA and is operatively linked to a promoter and a transcription termination sequence; (b) culturing the transformed plant cell under conditions sufficient to allow for development of a plant cell culture comprising a plurality of transformed plant cells; (c) selecting for transformed plant cells that have integrated the nucleic acid sequence into their genomes; (d) screening the transformed plant cells for expression of the dsRNA encoded by the nucleic acid sequence; and (e) selecting a plant cell that expresses the dsRNA. A method further comprising regenerating a plant from the plant cell that expresses the dsRNA; whereby expression of the gene in the plant is sufficient to modulate the expression of a target gene in a plant-parasitic nematode cell that contacts the transformed plant or plant cell is another embodiment of the invention.

DETAILED DESCRIPTION OF THE INVENTION

The following is a detailed description of the invention provided to aid those skilled in the art in practicing the present invention. Those of ordinary skill in the art may make modifications and variations in the embodiments described herein without departing from the spirit or scope of the present invention.

The present invention provides methods and compositions for genetic control of plant-parasitic nematode infestations, particularly for genetic control of *Pratylenchus* (root lesion) nematode infestations of plants. Root lesion nematodes (*Pratylenchus* spp.) are tylenchid plant parasitic nematodes that are one of the three most economically damaging genera of plant-parasitic nematodes on horticultural and field crops. Root lesion nematodes are migratory endoparasites that tunnel around inside roots producing characteristic necrotic lesions (darkened areas of dead tissue) on the surface and throughout the cortex of infected root. Lesion nematodes are distributed worldwide and are obligate parasites of the roots of hundreds of plant species including monocotyledonous and dicotyledonous herbaceous and woody plants. As is typical with other nematode species, root lesion nematodes grow through a series of lifecycle stages and molts. The first molt of the J1 larva (first juvenile stage) to the J2 stage occurs within the egg and then a J2 hatches and invades a suitable plant host. Within plant roots the J2 larvae feed on plants cells then go through a series of successive molts to J3, J4 and the then adult nematodes. The larvae and adults can exit and re-enter roots at any point during the life cycle.

Identification of genes essential in the lifecycle of a *Pratylenchus* plant-parasitic nematode and methods for their use as a target for dsRNA-mediated control of a nematode population are also provided by this invention. DNA plasmid vectors encoding dsRNA molecules are designed to suppress nematode genes essential for growth, development, feeding, or reproduction. For example, the present invention provides methods and recombinant DNA technologies for post-transcriptionally repressing or inhibiting expression of a target coding sequence in a plant-parasitic nematode to provide a protective effect by allowing the plant-parasitic nematode to ingest one or more double stranded or small interfering ribonucleic acid (RNA) molecules transcribed from all or a portion of a target coding sequence, thereby controlling the infection.

The present invention discloses nucleotide and amino acid sequences of the root lesion plant nematode pests, *Pratylenchus* spp., from gene targets that are conserved and essential to the viability of the plant parasitic nematodes. This invention further describes the use of these sequences to modify the expression of one or more target polynucleotide or protein molecules in at least the cells of a *Pratylenchus* species by providing in its diet a dsRNA that comprises a part of, or all, or substantially all, of one or more polynucleotide molecules of the present invention. Chimeric nucleic acid sequences constructed from multiple lesion species are also provided to facilitate the simultaneous targeting of multiple root lesion nematode species with small numbers of dsRNA constructs while providing selectivity over similar or homologous human and plant sequences, and also provides selectivity over similar or homologous sequences present in other non-target organisms like beneficial insects (e.g., bees or butterflies).

An environmentally benign but effective alternative for controlling root lesion nematodes is the use of RNA interference against essential nematode genes to control nematode infestation of plants. This is achieved through the transgenic expression of double stranded RNA (dsRNA) complementary to target nematode genes in plants. The complementarity of the dsRNA to a target gene may be perfect, i.e. 100%, in the sequence being targeted, or the sequence of the dsRNA may be substantially complementary, e.g. about 85%, 90% or 95% greater, along the sequence being targeted.

Therefore, the present invention relates to sequence-specific inhibition of expression of coding sequences using double-stranded RNA (dsRNA), including small interfering RNA (siRNA), to achieve the intended levels of root lesion nematode control.

A method for inhibiting target gene function within the root lesion nematodes, *Pratylenchus* spp, is also provided by the present invention, and can be accomplished by RNA interference, resulting in disruption of the pathogen's lifecycle. Optimal target genes for disruption include life-cycle essential genes where disruption results in high penetrance death of the parasite populations or "genetic death" by blocking of reproduction with minimal feeding damage to the plant, reduction in number of adult nematodes, minimizing the number of eggs produced, minimizing the viability of the eggs, and minimizing the number of viable escaping worms reaching the next generation. In particular embodiments, efficacy (i.e. inhibition of a target gene function) may be assayed by comparing the number of worms produced by *Pratylenchus* nematodes subjected to the methods and compositions of the present invention, versus the number of worms produced by *Pratylenchus* nematodes grown under similar conditions but not subjected to such methods and/or compositions. Another aspect of the present invention provides nucleic acids of target genes predicted to be essential to *Pratylenchus* spp. growth, and/or development, such as feeding or production of eggs. Features used to predict such targets include orthology to known *C. elegans* genes with strong and reproducible RNA interference phenotypes, the nature of the RNAi phenotype, orthology to RNAi validated genes in *H. glycines* (soybean cyst nematode) and expression pattern in *Pratylenchus* spp.

In yet another aspect of the present invention, a set of isolated and purified nucleotide sequences as set forth in SEQ ID NO:1-51 or SEQ ID NO:120-1064, or a complement thereof, is provided. The present invention also provides a stabilized dsRNA molecule for the expression of one or more RNAs for inhibition of expression of a target gene in a plant-parasitic nematode, expressed from these sequences and fragments thereof. A stabilized dsRNA, including a dsRNA or siRNA molecule can comprise at least two transcribed sequences, e.g. coding sequences that are arranged in a sense and an antisense orientation relative to at least one promoter, wherein the nucleotide sequence that comprises a sense strand and an antisense strand are linked or connected by a spacer sequence of at least from about one to about one thousand nucleotides, wherein the sense strand and the antisense strand may be a different length, and wherein each of the two transcribed sequences shares at least 80% sequence identity, at least 85%, at least 90%, at least 95%, at least 98%, at least 99%, or 100% sequence identity, to any one or more nucleotide sequence(s) set forth in SEQ ID NO:1-51 or SEQ ID NO:120-1064, or a complement thereof.

In yet another aspect, the invention provides recombinant DNA constructs comprising a nucleic acid molecule encoding a dsRNA molecule described herein. The dsRNA may be formed by transcription of one strand of the dsRNA molecule from a nucleotide sequence which is at least from about 80% to about 100% identical to a nucleotide sequence selected from the group consisting of: a fragment of at least 17, 18, 19, 20 or 21 contiguous nucleotides, up to the full length, of SEQ ID NO:1-51 and SEQ ID NO:120-1064, and a complement thereof. Such recombinant DNA constructs may be defined as producing dsRNA molecules capable of inhibiting the expression of endogenous target gene(s) in a plant-parasitic nematode cell upon ingestion. The construct may comprise a nucleotide sequence of the invention operably linked to a promoter sequence that functions in the host cell such as a plant cell. Such a promoter may be tissue-specific and may, for example, be specific to a tissue type which is the subject of plant-parasitic nematode attack. In the case of a root or foliar pathogen, respectively for example, it may be desired to use a promoter providing root or leaf-preferred expression, respectively.

Nucleic acid constructs in accordance with the invention may comprise at least one non-naturally occurring nucleotide sequence that can be transcribed into a single stranded RNA capable of forming a dsRNA molecule in vivo through intermolecular or intramolecular hybridization. Such dsRNA sequences self assemble and can be provided in the nutrition source of a plant-parasitic nematode to achieve the desired inhibition.

A recombinant DNA construct may comprise one or more different non-naturally occurring sequences which, when expressed in vivo as dsRNA sequences and provided in the tissues of the host plant of a plant-parasitic nematode, inhibit the expression of at least two different target genes in the plant-parasitic nematode. In certain embodiments, at least 2, 3, 4, 5, 6, 8 or 10 or more different dsRNAs are produced in a cell, or plant comprising the cell, that have a nematode-inhibitory effect. The dsRNAs may be expressed from multiple constructs introduced in different transformation events or could be introduced on a single nucleic acid molecule. The dsRNAs may be expressed using a single promoter or multiple promoters. In one embodiment of the invention, single dsRNAs are produced that comprise nucleic acids homologous to multiple loci within a plant-parasitic nematode.

In still yet another aspect, the invention provides a recombinant host cell having in its genome at least one recombinant DNA sequence that is transcribed to produce at least one dsRNA molecule that functions when ingested by a plant-parasitic nematode to inhibit the expression of a target gene in the nematode. The dsRNA molecule may be encoded by any of the nucleic acids described herein and as set forth in the sequence listing. The present invention also provides a transformed plant cell having in its genome at least one recombinant DNA sequence described herein. Transgenic plants comprising such a transformed plant cell are also provided, including progeny plants of any generation, seeds, and plant products, each comprising the recombinant DNA. The dsRNA molecules of the present invention may be found in the transgenic plant cell, for instance in the cytoplasm. They may also be found in an apoplastic space.

Further provided by the invention is a fragment of a nucleic acid sequence selected from the group consisting of SEQ ID NO:1-51 and SEQ ID NO:120-1064, and complements thereof. The fragment may be defined as causing the death, growth inhibition, reduced reproduction, or cessation of infestation or feeding by a *Pratylenchus* nematode, when expressed as a dsRNA and taken up by the nematode. The fragment may, for example, comprise at least about 17, 18, 19, 20, 21, 22, 23, 24, 25, 26, 27, 28, 29, 30, 40, 60, 80, 100, 125 or more contiguous nucleotides of any one or more of the sequences in SEQ ID NO:1-51 or SEQ ID NO:120-1064, or a complement thereof. One beneficial DNA segment for use in the present invention is at least from about 17, 18 or 19 to about 23, or about 23 to about 100 nucleotides, but less than about 2000 nucleotides, in length. Particularly useful will be dsRNA sequences including about 23 to about 300 nucleotides homologous to a nematode target sequence. The invention also provides a ribonucleic acid expressed from any of such sequences including a dsRNA. A sequence selected for use in expression of a gene suppression agent can be constructed from a single sequence derived from one or more target plant-parasitic nematode species and intended for use in expression of an RNA that functions in the suppression of a single gene or gene family in the one or more target pathogens, or that the DNA sequence can be constructed as a chimera from a plurality of DNA sequences.

In another embodiment, the invention provides a method for modulating expression of a target gene in a nematode cell, such as a cell of a *Pratylenchus* spp., the method comprising: (a) transforming a plant cell with a vector comprising a nucleic acid sequence operatively linked to a promoter and a transcription termination sequence, wherein the nucleic acid sequence encodes a dsRNA; (b) culturing the transformed plant cell under conditions sufficient to allow for development of a plant cell culture comprising a plurality of transformed plant cells; (c) selecting for transformed plant cells that have integrated the vector into their genomes; (d) screening the transformed plant cells for expression of the dsRNA encoded by the vector; (e) selecting a plant cell that expresses the dsRNA; (f) optionally regenerating a plant from the plant cell that expresses the dsRNA; whereby expression of the nucleic acid sequence in the plant is sufficient to modulate the expression of a target gene in a cell of a plant parasitic nematode that contacts the transformed plant or plant cell. Modulation of gene expression may include partial or complete suppression of such expression.

In yet another aspect, the invention provides a method for suppression of gene expression in a plant-parasitic nematode, comprising the provision in the tissue of the host of the nematode a gene-suppressive amount of at least one dsRNA molecule transcribed from a nucleotide sequence as described herein, at least one segment of which is complementary to an mRNA sequence within the cells of the plant-parasitic nematode. The method may further comprise observing the death, growth inhibition, or reduced reproduction of the plant-parasitic nematode, and the degree of host symptomatology. A dsRNA molecule, including its modified form such as an siRNA molecule, ingested by a pathogenic microorganism in accordance with the invention may be at least from about 80, 81, 82, 83, 84, 85, 86, 87, 88 89, 90, 91, 92, 93, 94, 95, 96, 97, 98, 99, or about 100% identical to a RNA molecule transcribed from all or a portion of a nucleotide sequence selected from the group consisting of SEQ ID NO:1-51 and SEQ ID NO:120-1064. In some cases over a region of 23, 22, 21, 20, 17, 18 or 17 nucleotides there is no more than one mismatch to the corresponding sequence within 23, 22, 21, 20, 17, 18 or 17 contiguous nucleotides of a nucleotide sequence selected from the group consisting of SEQ ID NO:1-51 and SEQ ID NO:120-1064.

Isolated and substantially purified nucleic acid molecules including, but not limited to, non-naturally occurring nucleotide sequences and recombinant DNA constructs for transcribing dsRNA molecules of the present invention are therefore provided, which suppress or inhibit the expression of an endogenous coding sequence or a target coding sequence in the plant-parasitic nematode when introduced thereto. Transgenic plants that (a) contain nucleotide sequences encoding the isolated and substantially purified nucleic acid molecules and the non-naturally occurring recombinant DNA constructs for transcribing the dsRNA molecules for controlling plant-parasitic nematode infections, and (b) display resistance and/or enhanced tolerance to the infections, are also contemplated. Compositions containing the dsRNA nucleotide sequences of the present invention for use in topical applications onto plants or onto animals or into the environment of an animal to achieve the elimination or reduction of plant-parasitic nematode infection are also included.

cDNA sequences encoding proteins or parts of proteins essential for survival, such as amino acid sequences involved in various metabolic or catabolic biochemical pathways, cell division, reproduction, energy metabolism, digestion, and the like may be selected for use in preparing double stranded RNA molecules to be provided in the host plant of a plant-parasitic nematode. As described herein, ingestion of compositions by a target organism containing one or more dsRNAs, at least one segment of which corresponds to at least a substantially identical segment of RNA produced in the cells of the target pathogen, can result in the death or other inhibition of the target organism. These results indicate that a nucleotide sequence, either DNA or RNA, derived from a plant-parasitic nematode can be used to construct plant cells resistant to infestation by the nematode. The host plant of the nematode, for example, can be transformed to contain one or more of the nucleotide sequences derived from the nematode as provided herein. The nucleotide sequence transformed into the host may encode one or more RNAs that form into a dsRNA sequence in the cells or biological fluids within the transformed host, thus making the dsRNA available if/when the plant-parasitic nematode forms a nutritional relationship with the transgenic host. This may result in the suppression of expression of one or more genes in the cells of the plant-parasitic *Pratylenchus* spp. nematode and ultimately death or inhibition of its growth, development, or reproduction.

The present invention relates generally to genetic control of plant-parasitic nematodes in host organisms. More particularly, the present invention includes methods for delivery of nematode control agents to plant-parasitic nematodes. Such control agents cause, directly or indirectly, an impairment in the ability of the plant-parasitic nematode to feed, grow or otherwise cause disease in a target host. The present invention provides in one embodiment a method comprising delivery of stabilized dsRNA molecules to plant-parasitic nematodes as a means for suppression of targeted genes in the plant-parasitic nematode, thus achieving desired control of plant disease in the nematode host.

In accomplishing the foregoing, the present invention provides a method of inhibiting expression of a target gene in a plant-parasitic nematode, resulting in the impairment of growth, development, reproduction, and/or feeding, and eventually may result in the death of the plant-parasitic nematode. The method comprises in one embodiment introducing partial or fully stabilized double-stranded RNA (dsRNA) nucleotide molecules, including its modified forms such as small interfering RNA (siRNA) sequences, into a nutritional composition for the plant-parasitic nematode, and making the nutritional composition or food source available to the plant-parasitic nematode. Ingestion of the nutritional composition containing the double stranded or siRNA molecules results in the uptake of the molecules by the cells of the nematode, resulting in the inhibition of expression of at least one target gene in the cells of the nematode. Inhibition of the target gene exerts a deleterious effect upon the nematode. The methods and associated compositions may be used for limiting or eliminating infection or parasitization of a plant or plant cell by a nematode, in or on any host tissue or environment in which a the nematode is present by providing one or more compositions comprising the dsRNA molecules described herein in the host of the nematode.

In certain embodiments, dsRNA molecules provided by the invention comprise nucleotide sequences complementary to a sequence as set forth in any of SEQ ID NO:1-51 or SEQ ID NO:120-1064, the inhibition of which in a plant-parasitic nematode results in the reduction or removal of a protein or nucleotide sequence agent that is essential for the nematode's growth and development, reproduction, or other biological function. The nucleotide sequence selected may exhibit from about 80% to about 100% sequence identity to one of the nucleotide sequences as set forth in SEQ ID NO:1-51 or SEQ ID NO:120-1064, or a fragment of at least 17, 18, 19, 20 or 21 contiguous nucleotides thereof, up to the full length of the sequence, including the complement thereof. In certain other embodiments, DNA sequences capable of coding for efficacious dsRNA molecules are selected from the group consisting of SEQ ID NO:1-51 or complement thereof. Such inhibition can be described as specific in that a nucleotide sequence from a portion of the target gene is chosen from which the inhibitory dsRNA or siRNA is transcribed. The method is effective in inhibiting the expression of at least one target gene and can be used to inhibit many different types of target genes in the plant-parasitic nematode.

The sequences identified as having a nematode-protective effect may be readily expressed as dsRNA molecules through the creation of appropriate expression constructs. For example, such sequences can be expressed as a hairpin and stem and loop structure by taking a first segment corresponding to a sequence selected from SEQ ID NO:1-51 or SEQ ID NO:120-1064 or a fragment thereof; linking this sequence to a second segment spacer region that is not homologous or complementary to the first segment; and linking this to a third segment that transcribes an RNA, wherein at least a portion of the third segment is substantially complementary to the first segment. Such a construct forms a stem and loop structure by hybridization of the first segment with the third segment and a loop structure forms comprising the second segment (WO94/01550, WO98/05770, US 2002/0048814A1, and US 2003/0018993A1). DsRNA may be generated for instance in the form of a double stranded structure such as a stem loop structure (e.g. hairpin), whereby production of siRNA targeted for a nematode sequence is enhanced by co-expression of a fragment of the targeted gene, for instance on an additional plant expressible cassette, that leads to enhanced siRNA production, or reduces methylation to prevent transcriptional gene silencing of the dsRNA hairpin promoter (e.g. WO05/019408).

Exemplary species of the *Pratylenchus* genera which are contemplated in this invention include *Pratylenchus brachyurus, Pratylenchus coffeae, Pratylenchus crenatus, Pratylenchus dulscus, Pratylenchus fallax, Pratylenchus flakkensis, Pratylenchus goodeyi, Pratylenchus hexincisus, Pratylenchus loosi, Pratylenchus minutus, Pratylenchus mulchandi, Pratylenchus musicola, Pratylenchus neglectus, Pratylenchus penetrans, Pratylenchus pratensis, Pratylenchus reniformia, Pratylenchus scribneri, Pratylenchus thornei, Pratylenchus vulnus, Pratylenchus zeae*. Other plant parasitic nematode genera which can be found together with root lesion nematodes include, *Globodera, Meloidogyne, Paratrichodorus, Radopholus, Hoplolaimus, Ditylenchus, Dolichodorus, Helicotylenchus, Hirschmanniella, Xiphinema, Rotylenchulus, Trichodorus, Tylenchorhynchus, Belonolaimus* and *Longidorus* among others The methods and compositions of the present invention may be applied to any monocot or dicot plant, depending on the pathogen (e.g. nematode) control desired. Exemplary plants protected by the present invention from root lesion and other plant-parasitic nematodes species associated with them include but are not limited to: alfalfa: *Pratylenchus* spp., *Meloidogyne hapla, Meloidogyne incognita, Meloidogyne javanica, Ditylenchus dipsaci, Paratylenchus* spp., *Xiphinema* spp.; banana: *Pratylenchus coffeae, M. incognita, M. arenaria, M. javanica, Radopholus similis, Helicotylenchus multicinctus, Rotylenchulus reniformis*; cereals (barley, wheat, rye): *Pratylenchus* spp., *Meloidogyne naasi*; chickpea: *Pratylenchus* spp., *Meloidogyne* spp., *Heterodera cajani, Rotylenchulus reniformis, Hoplolaimus seinhorsti*; citrus: *Pratylenchus* spp., *Meloidogyne* spp., *Tylenchulus semipenetrans, Radopholus similis, Radopholus citrophilus, Hemicycliophora arenaria, Bolonolaimus longicaudatus, Trichodorus* spp., *Paratrichodorus* spp., *Xiphinema* spp.; clover: *Pratylenchus* spp., *Meloidogyne* spp., *Heterodera trifolii*; corn: *Pratylenchus brachyurus, Pratylenchus hexincisus, Pratylenchus penetrans, Pratylenchus scribneri, Pratylenchus zeae, Meloidogyne incognita, Paratrichodorus minor, Longidorus* spp., *Hoplolaimus columbus*; cotton: *Pratylenchus* spp., *Meloidogyne incognita, Belonolaimus longicaudatus, Rotylenchulus reniformis, Hoplolaimus galeatus, Tylenchorhynchus* spp., *Paratrichodorus minor*; grapes: *Pratylenchus vulnus, Meloidogyne* spp., *Xiphinema* spp., *Tylenchulus semipenetrans, Rotylenchulus reniformis*; grasses: *Pratylenchus* spp., *Longidorus* spp., *Paratrichodorus christiei, Xiphinema* spp., *Ditylenchus* spp.; peanut: *Pratylenchus* spp., *Meloidogyne hapla., Meloidogyne arenaria, Criconemella* spp., *Belonolaimus longicaudatus*; pigeon pea: *Pratylenchus* spp., *Meloidogyne* spp., *Heterodera cajani, Rotylenchulus reniformis, Hoplolaimus seinhorsti*; potato: *Pratylenchus* spp., *Meloidogyne* spp., *Glo-* bodera rostochiensis, Globodera pallida, Trichodorus primitivus, Ditylenchus spp., Paratrichodorus spp., Nacobbus aberrans; rice: Pratylenchus spp., Meloidogyne spp., Aphelenchiodes besseyi, Ditylenchus angustus, Hirchmanniella spp., Heterodera oryzae; small fruits: Pratylenchus spp., Meloidogyne spp.; Xiphinema spp., Longidorus spp., Paratrichodorus christiei, Aphelenchoides spp.; soybean: Pratylenchus spp., Meloidogyne incognita, Meloidogyne javanica, Heterodera glycines, Belonolaimus spp., Hoplolaimus columbus; sugar beet: Pratylenchus spp., Meloidogyne spp., Heterodera schachtii, Ditylenchus dipsaci, Nacobbus aberrans, Trichodorus spp., Longidorus spp., Paratrichodorus spp.; sugar cane: Pratylenchus spp., Meloidogyne spp., Radopholus spp., Heterodera spp., Hoplolaimus spp., Helicotylenchus spp., Scutellonema spp., Belonolaimus spp., Tylenchorhynchus spp., Xiphinema spp., Longidorus spp., Paratrichodorus spp.; tobacco: Pratylenchus spp., Meloidogyne spp., Tylenchorhynchus claytoni, Globodera tabacum, Trichodorus spp., Xiphinema americanum, Ditylenchus dipsaci, Paratrichodorus spp.; and tomato: Pratylenchus spp., Meloidogyne spp.

The various aspects of this invention are especially useful for transgenic plants having nematode resistance activity that include, without limitation, corn, cereals, including wheat, barley, rye, and rice, potato, tomato, cucumber, pepper, clovers, legumes, including soybeans (Glycine sp.), peas and alfalfa, sugar cane, sugar beets, tobacco, carrot, cotton (Gossypium sp.), rapeseed (canola), sunflower, safflower, sorghum, strawberry, banana, turf, and ornamentals among others.

The invention also provides combinations of methods and compositions for controlling infection by plant-parasitic nematodes. One means provides a dsRNA method as described herein for protecting plants from plant-parasitic nematodes along with one or more chemical agents that exhibit features different from those exhibited by the dsRNA methods and compositions, and can interfere with nematode growth, development, or reproduction.

A. Nucleic Acid Compositions and Constructs

The invention provides recombinant DNA constructs for use in achieving stable transformation of particular host targets. Transformed host targets may express effective levels of preferred dsRNA or siRNA molecules from the recombinant DNA constructs. Pairs of isolated and purified nucleotide sequences may be provided from cDNA library and/or genomic library information. The pairs of nucleotide sequences may be derived from any nematode for use as thermal amplification primers to generate the dsRNA and siRNA molecules of the present invention.

As used herein, the term "nucleic acid" refers to a single or double-stranded polymer of deoxyribonucleotide or ribonucleotide bases read from the 5' to the 3' end. The "nucleic acid" may also optionally contain non-naturally occurring or altered nucleotide bases that permit correct read through by a polymerase and do not reduce expression of a polypeptide encoded by that nucleic acid. The term "nucleotide sequence" or "nucleic acid sequence" refers to both the sense and antisense strands of a nucleic acid as either individual single strands or in the duplex. The term "ribonucleic acid" (RNA) is inclusive of RNAi (inhibitory RNA), dsRNA (double stranded RNA), siRNA (small interfering RNA), shRNA (small hairpin RNA), mRNA (messenger RNA), miRNA (micro-RNA), tRNA (transfer RNA, whether charged or discharged with a corresponding acylated amino acid), and cRNA (complementary RNA) and the term "deoxyribonucleic acid" (DNA) is inclusive of cDNA and genomic DNA and DNA-RNA hybrids. The words "nucleic acid segment", "nucleotide sequence segment", or more generally "segment" will be understood by those in the art as a functional term that includes both genomic sequences, ribosomal RNA sequences, transfer RNA sequences, messenger RNA sequences, operon sequences and smaller engineered nucleotide sequences that express or may be adapted to express, proteins, polypeptides or peptides.

Provided according to the invention are nucleotide sequences, the expression of which results in an RNA sequence which is substantially homologous to all or part of an RNA molecule of a targeted gene in a plant-parasitic nematode that comprises an RNA sequence encoded by a nucleotide sequence within the genome of the nematode. Thus, after ingestion of the stabilized RNA sequence down-regulation of the nucleotide sequence of the target gene in the cells of the plant-parasitic nematode may be obtained resulting in a deleterious effect on the growth, viability, proliferation, or reproduction of the nematode.

As used herein, the term "substantially homologous" or "substantial homology", with reference to a nucleic acid sequence, includes a nucleotide sequence that hybridizes under stringent conditions to the coding sequence of any of SEQ ID NO:1-51 or SEQ ID NO:120-1064, as set forth in the sequence listing, or the complements thereof. Sequences that hybridize under stringent conditions to any of SEQ ID NO:1-51 or SEQ ID NO:120-1064, or a complement thereof, are those that allow an antiparallel alignment to take place between the two sequences, and the two sequences are then able, under stringent conditions, to form hydrogen bonds with corresponding bases on the opposite strand to form a duplex molecule that is sufficiently stable under conditions of appropriate stringency, including high stringency, to be detectable using methods well known in the art. Substantially homologous sequences have preferably from about 70% to about 80% sequence identity, or more preferably from about 80% to about 85% sequence identity, or most preferable from about 90% to about 95% sequence identity, to about 99% sequence identity, to the referent nucleotide sequences as set forth in any of SEQ ID NO:1-51 or SEQ ID NO:120-1064, in the sequence listing, or the complements thereof.

As used herein, the term "ortholog" refers to a gene in two or more species that has evolved from a common ancestral nucleotide sequence, and may retain the same function in the two or more species.

As used herein, the term "sequence identity", "sequence similarity" or "homology" is used to describe sequence relationships between two or more nucleotide sequences. The percentage of "sequence identity" between two sequences is determined by comparing two optimally aligned sequences over a comparison window, wherein the portion of the sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity. A sequence that is identical at every position in comparison to a reference sequence is said to be identical to the reference sequence and vice-versa. A first nucleotide sequence when observed in the 5' to 3' direction is said to be a "complement" of, or complementary to, a second or reference nucleotide sequence observed in the 3' to 5' direction if the first nucleotide sequence exhibits complete complementarity with the second or reference sequence. As used herein, nucleic acid sequence molecules are said to exhibit "complete complementarity" when every nucleotide of one of the sequences read 5' to 3' is complementary to every nucleotide of the other sequence when read 3' to 5'. A nucleotide sequence that is complementary to a reference nucleotide sequence will exhibit a sequence identical to the reverse complement sequence of the reference nucleotide sequence. These terms and descriptions are well defined in the art and are easily understood by those of ordinary skill in the art.

As used herein, a "comparison window" refers to a conceptual segment of at least 6 contiguous positions, usually about 50 to about 100, more usually about 100 to about 150, in which a sequence is compared to a reference sequence of the same number of contiguous positions after the two sequences are optimally aligned. The comparison window may comprise additions or deletions (i.e. gaps) of about 20% or less as compared to the reference sequence (which does not comprise additions or deletions) for optimal alignment of the two sequences Those skilled in the art should refer to the detailed methods used for sequence alignment in the Wisconsin Genetics Software Package Release 7.0, Genetics Computer Group, 575 Science Drive Madison, Wis., USA) or refer to Ausubel et al. (1998) for a detailed discussion of sequence analysis.

The present invention provides DNA sequences capable of being expressed as an RNA transcript in a cell or microorganism to inhibit target gene expression in a cell, tissue or organ of a plant-parasitic nematode. The sequences comprise a DNA molecule coding for one or more different nucleotide sequences, wherein each of the different nucleotide sequences comprises a sense nucleotide sequence and an antisense nucleotide sequence. The sequences may be connected by a spacer sequence coding for a portion of a dsRNA molecule of the present invention. The spacer sequence can constitute part of the sense nucleotide sequence or the antisense nucleotide sequence or an unrelated nucleotide sequence and forms within the dsRNA molecule between the sense and antisense sequences. The sense nucleotide sequence or the antisense nucleotide sequence is substantially identical to the nucleotide sequence of the target gene or a derivative thereof or a complementary sequence thereto. The dsDNA molecule may be placed operably under the control of a promoter sequence that functions in the cell, tissue or organ of the host expressing the dsDNA to produce dsRNA molecules. In certain embodiments, the DNA sequence may be derived from a nucleotide sequence as set forth in SEQ ID NO:1-51 or SEQ ID NO:120-1064, or a complement thereof, in the sequence listing.

The invention also provides a DNA sequence for expression in a cell of a plant that, upon expression of the DNA to RNA and ingestion by a plant-parasitic nematode achieves suppression of a target gene in a cell, tissue or organ of a plant-parasitic nematode. The dsRNA may comprise one or multiple structural gene sequences, wherein each of the structural gene sequences comprises a sense nucleotide sequence and an antisense nucleotide sequence that may be connected by a spacer sequence that forms a loop within the complementary and antisense sequences. The sense nucleotide sequence or the antisense nucleotide sequence is substantially identical to the nucleotide sequence of the target gene, derivative thereof, or sequence complementary thereto. The one or more structural gene sequences may be placed operably under the control of one or more promoter sequences, at least one of which is operable in the cell, tissue or organ of a prokaryotic or eukaryotic organism, particularly a plant cell. Methods to express a gene suppression molecule in plants are known (e.g. US Publication 2006/0200878 A1), and may be used to express a nucleotide sequence of the present invention.

A gene sequence or fragment for plant-parasitic nematode control according to the invention may be cloned between two tissue specific promoters, such as two root specific promoters which are operable in a transgenic plant cell and therein expressed to produce mRNA in the transgenic plant cell that form dsRNA molecules thereto. Examples of root specific promoters are known in the art (e.g. the nematode-induced RB7 promoter; U.S. Pat. No. 5,459,252; Opperman et al. 1994). The dsRNA molecules contained in plant tissues are ingested by a plant-parasitic nematode so that the intended suppression of the target gene expression is achieved.

The cauliflower mosaic virus 35S promoter, an archetypal strong promoter common in transgenic plant applications, or a related promoter such as the E35S or the FMV promoter, may be employed for driving nematode resistance genes, particularly for root lesion nematodes.

A nucleotide sequence provided by the present invention may comprise an inverted repeat separated by a "spacer sequence." The spacer sequence may be a region comprising any sequence of nucleotides that facilitates secondary structure formation between each repeat, where this is required. In one embodiment of the present invention, the spacer sequence is part of the sense or antisense coding sequence for mRNA. The spacer sequence may alternatively comprise any combination of nucleotides or homologues thereof that are capable of being linked covalently to a nucleic acid molecule. The spacer sequence may comprise, for example, a sequence of nucleotides of at least about 4, 5, 6, 7, 8, 9 or 10-100 nucleotides in length, or alternatively at least about 100-200 nucleotides in length, at least 200-400 about nucleotides in length, or at least about 400-500 nucleotides in length.

The nucleic acid molecules or fragments of the nucleic acid molecules or other nucleic acid molecules in the sequence listing are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the complement of another nucleic acid molecule if they exhibit complete complementarity. Two molecules are said to be "minimally complementary" if they can hybridize to one another with sufficient stability to permit them to remain annealed to one another under at least conventional "low-stringency" conditions. Similarly, the molecules are said to be complementary if they can hybridize to one another with sufficient stability to permit them to remain annealed to one another under conventional "high-stringency" conditions. Conventional stringency conditions are described by Sambrook, et al. (1989), and by Haymes et al. (1985).

Departures from complete complementarity are therefore permissible, as long as such departures do not completely preclude the capacity of the molecules to form a double-stranded structure. Thus, in order for a nucleic acid molecule or a fragment of the nucleic acid molecule to serve as a primer or probe it needs only be sufficiently complementary in sequence to be able to form a stable double-stranded structure under the particular solvent and salt concentrations employed.

Appropriate stringency conditions which promote DNA hybridization are, for example, for applications requiring high selectivity, with relatively low salt and/or high temperature conditions, such as provided by about 0.02 M to about 0.15 M NaCl at temperatures of about 50° C. to about 70° C.

A high stringency condition, for example, is to wash the hybridization filter at least twice with high-stringency wash buffer (0.2×SSC or 1×SSC, 0.1% SDS, 65° C.). Other conditions, such as 6.0× sodium chloride/sodium citrate (SSC) at about 45° C., followed by a wash of 2.0×SSC at 50° C., are also known to those skilled in the art or can be found in Current Protocols in Molecular Biology (1989). For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed. A nucleic acid for use in the present invention may specifically hybridize to one or more of nucleic acid molecules from a nematode or complements thereof under such conditions. Preferably, a nucleic acid for use in the present invention will exhibit at least from about 80%, or at least from about 90%, or at least from about 95%, or at least from about 98%, or at least from about 99%, or even about 100% sequence identity with one or more nucleic acid molecules as set forth in SEQ ID NO:1-51 or SEQ ID NO:120-1064, or a complement thereof, in the sequence listing.

Nucleic acids of the present invention may also be synthesized, either completely or in part, especially where it is desirable to provide plant-preferred sequences, by methods known in the art. Thus, all or a portion of the nucleic acids of the present invention may be synthesized using codons preferred by a selected host. Species-preferred codons may be determined, for example, from the codons used most frequently in the proteins expressed in a particular host species. Other modifications of the nucleotide sequences may result in mutants having slightly altered activity.

DsRNA or siRNA nucleotide sequences comprise double strands of polymerized ribonucleotide and may include modifications to either the phosphate-sugar backbone or the nucleoside. Modifications in RNA structure may be tailored to allow specific genetic inhibition. In one embodiment, the dsRNA molecules may be modified through an enzymatic process so that siRNA molecules may be generated. The siRNA can efficiently mediate the down-regulation effect for some target genes in some pathogens. This enzymatic process may be accomplished by utilizing an RNAse III enzyme or a DICER enzyme, present in the cells of an insect, a vertebrate animal, a fungus or a plant in the eukaryotic RNAi pathway (Elbashir et al., 2001; Hamilton and Baulcombe, 1999). This process may also utilize a recombinant DICER or RNAse III introduced into the cells of a target insect through recombinant DNA techniques that are readily known to the skilled in the art. Both the DICER enzyme and RNAse III, being naturally occurring in a pathogen or being made through recombinant DNA techniques, cleave larger dsRNA strands into smaller oligonucleotides. The DICER enzymes specifically cut the dsRNA molecules into siRNA pieces each of which is about 19-25 nucleotides in length while the RNAse III enzymes normally cleave the dsRNA molecules into 12-15 base-pair siRNA. The siRNA molecules produced by the either of the enzymes have 2 to 3 nucleotide 3' overhangs, and 5' phosphate and 3' hydroxyl termini. The siRNA molecules generated by RNAse III enzyme are the same as those produced by Dicer enzymes in the eukaryotic RNAi pathway and are hence then targeted and degraded by an inherent cellular RNA-degrading mechanism after they are subsequently unwound, separated into single-stranded RNA and hybridize with the RNA sequences transcribed by the target gene. This process results in the effective degradation or removal of the RNA sequence encoded by the nucleotide sequence of the target gene in the pathogen. The outcome is the silencing of a particularly targeted nucleotide sequence within the pathogen. Detailed descriptions of enzymatic processes can be found in Hannon (2002).

A nucleotide sequence of the present invention can be recorded on computer readable media. As used herein, "computer readable media" refers to any tangible medium of expression that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; optical character recognition formatted computer files, and hybrids of these categories such as magnetic/optical storage media. A skilled artisan can readily appreciate that any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII text file, stored in a database application, such as DB2, Sybase, Oracle, or the like. The skilled artisan can readily adapt any number of data processor structuring formats (e.g. text file or database) in order to obtain computer readable medium having recorded thereon the nucleotide sequence information of the present invention.

Computer software is publicly available which allows a skilled artisan to access sequence information provided in a computer readable medium. Software that implements the BLAST (Altschul et al., 1990) and BLAZE (Brutlag, et al., 1993) search algorithms on a Sybase system can be used to identify open reading frames (ORFs) within sequences such as the Unigenes and EST's that are provided herein and that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention.

The minimum hardware means of the computer-based systems of the present invention comprises a central processing unit (CPU), input means, output means, and data storage means. A skilled artisan can readily appreciate that any one of the currently available computer-based system are suitable for use in the present invention.

As used herein, "a target structural motif," or "target motif," refers to any rationally selected sequence or combination of sequences in which the sequences or sequence(s) are chosen based on a three-dimensional configuration that is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

B. Recombinant Vectors and Host Cell Transformation

A recombinant DNA vector may, for example, be a linear or a closed circular plasmid. The vector system may be a single vector or plasmid or two or more vectors or plasmids that together contain the total DNA to be introduced into the genome of the bacterial host. In addition, a bacterial vector may be an expression vector. Nucleic acid molecules as set forth in SEQ ID NO:1-51 or SEQ ID NO:120-1064, or complements or fragments thereof, can, for example, be suitably inserted into a vector under the control of a suitable promoter that functions in one or more microbial hosts to drive expression of a linked coding sequence or other DNA sequence. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, and an inducible promoter allowing the expression of exogenous DNA.

Expression and cloning vectors generally contain a selection gene, also referred to as a selectable marker. This gene encodes a protein necessary for the survival or growth of transformed host cells grown in a selective culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. Those cells that are successfully transformed with a heterologous protein or fragment thereof produce a protein conferring drug resistance and thus survive the selection regimen.

An expression vector for producing a mRNA can also contain an inducible promoter that is recognized by a host bacterial organism and is operably linked to the nucleic acid. Inducible promoters suitable for use with bacterial hosts include β-lactamase promoter, E. coli λ phage PL and PR promoters, and E. coli galactose promoter, arabinose promoter, alkaline phosphatase promoter, tryptophan (trp) promoter, and the lactose operon promoter and variations thereof and hybrid promoters such as the tac promoter. However, other known bacterial inducible promoters are suitable.

The term "operably linked", as used in reference to a regulatory sequence and a structural nucleotide sequence, means that the regulatory sequence causes regulated expression of the linked structural nucleotide sequence. "Regulatory sequences" or "control elements" refer to nucleotide sequences located upstream (5' noncoding sequences), within, or downstream (3' non-translated sequences) of a structural nucleotide sequence, and which influence the timing and level or amount of transcription, RNA processing or stability, or translation of the associated structural nucleotide sequence. Regulatory sequences may include promoters, translation leader sequences, introns, enhancers, stem-loop structures, repressor binding sequences, and polyadenylation recognition sequences and the like.

Construction of suitable vectors containing one or more of the above-listed components employs standard recombinant DNA techniques. Isolated plasmids or DNA fragments are cleaved, tailored, and re-ligated in the form desired to generate the plasmids required. Examples of available bacterial expression vectors include, but are not limited to, the multifunctional E. coli cloning and expression vectors such as Bluescript™ (Stratagene, La Jolla, Calif.), in which, for example, a nucleic acid, or fragment thereof may be ligated into the vector in frame with sequences for the amino-terminal Met and the subsequent 7 residues of β-galactosidase so that a hybrid protein is produced; pIN vectors (Van Heeke and Schuster, 1989); and the like.

The present invention also contemplates transformation of a nucleotide sequence of the present invention into a plant to achieve nematode-inhibitory levels of expression of one or more dsRNA molecules. A transformation vector can be readily prepared using methods available in the art. The transformation vector comprises one or more nucleotide sequences that is/are capable of being transcribed to an RNA molecule and that is/are substantially homologous and/or complementary to one or more nucleotide sequences encoded by the genome of the target nematode, such that upon uptake of the RNA transcribed from the one or more nucleotide sequences by the target plant-parasitic nematode, there is down-regulation of expression of at least one of the respective nucleotide sequences of the genome of the nematode.

The transformation vector may be termed a dsDNA construct and may also be defined as a recombinant molecule, a disease control agent, a genetic molecule or a chimeric genetic construct. A chimeric genetic construct of the present invention may comprise, for example, nucleotide sequences encoding one or more antisense transcripts, one or more sense transcripts, one or more of each of the aforementioned, wherein all or part of a transcript there from is homologous to all or part of an RNA molecule comprising an RNA sequence encoded by a nucleotide sequence within the genome of a pathogen.

In one embodiment a plant transformation vector comprises an isolated and purified DNA molecule comprising a heterologous promoter operatively linked to one or more nucleotide sequences of the present invention. The nucleotide sequence is selected from the group consisting of SEQ ID NO:1-51 and SEQ ID NO:120-1064, and complements thereof, as set forth in the sequence listing. The nucleotide sequence includes a segment coding all or part of an RNA present within a targeted nematode RNA transcript and may comprise inverted repeats of all or a part of a targeted nematode RNA. The DNA molecule comprising the expression vector may also contain a functional intron sequence positioned either upstream of the coding sequence or even within the coding sequence, and may also contain a five prime (5') untranslated leader sequence (i.e., a UTR or 5'-UTR) positioned between the promoter and the point of translation initiation.

A plant transformation vector may contain sequences from more than one gene, thus allowing production of more than one dsRNA for inhibiting expression of two or more genes in cells of a target nematode. One skilled in the art will readily appreciate that segments of DNA whose sequence corresponds to that present in different genes can be combined into a single composite DNA segment for expression in a transgenic plant. Alternatively, a plasmid of the present invention already containing at least one DNA segment can be modified by the sequential insertion of additional DNA segments between the enhancer and promoter and terminator sequences. In the disease control agent of the present invention designed for the inhibition of multiple genes, the genes to be inhibited can be obtained from the same plant-parasitic nematode species in order to enhance the effectiveness of the control agent. In certain embodiments, the genes can be derived from different plant-parasitic nematodes in order to broaden the range of nematodes against which the agent(s) is/are effective. When multiple genes are targeted for suppression or a combination of expression and suppression, a polycistronic DNA element can be fabricated as illustrated and disclosed in US Publication No. US 2004-0029283.

Promoters that function in different plant species are also well known in the art. Promoters useful for expression of polypeptides in plants include those that are inducible, viral, synthetic, or constitutive as described in Odell et al. (1985), and/or promoters that are temporally regulated, spatially regulated, and spatio-temporally regulated. Preferred promoters include the enhanced CaMV35S promoters, and the FMV35S promoter. A fragment of the CaMV35S promoter exhibiting root-specificity may also be preferred. For the purpose of the present invention, it may be preferable to achieve the highest levels of expression of these genes within the root tissues of plants. A number of root-specific promoters have been identified and are known in the art (e.g. U.S. Pat. Nos. 5,110,732; 5,837,848; 5,459,252; Hirel et al. 1992).

A recombinant DNA vector or construct of the present invention may comprise a selectable marker that confers a selectable phenotype on plant cells. Selectable markers may also be used to select for plants or plant cells that contain the exogenous nucleic acids encoding polypeptides or proteins of the present invention. The marker may encode biocide resistance, antibiotic resistance (e.g., kanamycin, G418 bleomycin, hygromycin, etc.), or herbicide resistance (e.g., glyphosate, etc.). Examples of selectable markers include, but are not limited to, a neo gene which codes for kanamycin resistance and can be selected for using kanamycin, G418, etc., a bar gene which codes for bialaphos resistance; a mutant EPSP synthase gene which encodes glyphosate resistance; a nitrilase gene which confers resistance to bromoxynil; a mutant acetolactate synthase gene (ALS) which confers imidazolinone or sulfonylurea resistance; and a methotrexate resistant DHFR gene. Multiple selectable markers are available that confer resistance to ampicillin, bleomycin, chloramphenicol, gentamycin, hygromycin, kanamycin, lincomycin, methotrexate, phosphinothricin, puromycin, spectinomycin, rifampicin, and tetracycline, and the like. Examples of such selectable markers are illustrated in U.S. Pat. Nos. 5,550,318; 5,633,435; 5,780,708 and 6,118,047.

A recombinant vector or construct of the present invention may also include a screenable marker. Screenable markers may be used to monitor expression. Exemplary screenable markers include a β-glucuronidase or uidA gene (GUS) which encodes an enzyme for which various chromogenic substrates are known (Jefferson et al., 1987); one or more of the various fluorescent proteins (FP) genes such as green fluorescent protein (GFP), red fluorescent protein (RFP) or any one of a large family of proteins which typically fluoresce at a characteristic wavelength; an R-locus gene, which encodes a product that regulates the production of anthocyanin pigments (red color) in plant tissues (Dellaporta et al., 1988); a β-lactamase gene (Sutcliffe et al., 1978), a gene which encodes an enzyme for which various chromogenic substrates are known (e.g., PADAC, a chromogenic cephalosporin); a luciferase gene (Ow et al., 1986) a xylE gene (Zukowski et al., 1983) which encodes a catechol dioxygenase that can convert chromogenic catechols; an α-amylase gene (Ikatu et al., 1990); a tyrosinase gene (Katz et al., 1983) which encodes an enzyme capable of oxidizing tyrosine to DOPA and dopaquinone which in turn condenses to melanin; an α-galactosidase, which catalyzes a chromogenic α-galactose substrate.

Preferred plant transformation vectors include those derived from a Ti plasmid of *Agrobacterium tumefaciens* (e.g. U.S. Pat. Nos. 4,536,475, 4,693,977, 4,886,937, 5,501,967 and EP 0 122 791). *Agrobacterium rhizogenes* plasmids (or "Ri") are also useful and known in the art. Other preferred plant transformation vectors include those disclosed, e.g., by Herrera-Estrella (1983); Bevan (1983), Klee (1985) and EP 0 120 516.

In general it may be preferred to introduce a functional recombinant DNA at a non-specific location in a plant genome. In special cases it may be useful to insert a recombinant DNA construct by site-specific integration. Several site-specific recombination systems exist which are known to function in plants include cre-lox as disclosed in U.S. Pat. No. 4,959,317 and FLP-FRT as disclosed in U.S. Pat. No. 5,527, 695.

Suitable methods for transformation of host cells for use with the current invention are believed to include virtually any method by which DNA can be introduced into a cell (see, for example, Miki et al., 1993), such as by transformation of protoplasts (U.S. Pat. No. 5,508,184; Omirulleh et al., 1993), by desiccation/inhibition-mediated DNA uptake (Potrykus et al., 1985), by electroporation (U.S. Pat. No. 5,384,253), by agitation with silicon carbide fibers (Kaeppler et al., 1990; U.S. Pat. No. 5,302,523; and U.S. Pat. No. 5,464,765), by *Agrobacterium*-mediated transformation (U.S. Pat. Nos. 5,563,055; 5,591,616; 5,693,512; 5,824,877; 5,981,840; 6,384,301) and by acceleration of DNA coated particles (U.S. Pat. Nos. 5,015,580; 5,550,318; 5,538,880; 6,160,208; 6,399, 861; 6,403,865; Padgette et al. 1995), etc. Through the application of techniques such as these, the cells of virtually any species may be stably transformed. In the case of multicellular species, the transgenic cells may be regenerated into transgenic organisms.

The most widely utilized method for introducing an expression vector into plants is based on the natural transformation system of *Agrobacterium* (for example, Horsch et al., 1985). *A. tumefaciens* and *A. rhizogenes* are plant pathogenic soil bacteria which genetically transform plant cells. The Ti and Ri plasmids of *A. tumefaciens* and *A. rhizogenes*, respectively, carry genes responsible for genetic transformation of the plant. Descriptions of *Agrobacterium* vector systems and methods for *Agrobacterium*-mediated gene transfer are provided by numerous references, including Gruber et al. 1993; Miki et al., 1993, Moloney et al., 1989, and U.S. Pat. Nos. 4,940,838 and 5,464,763. Other bacteria such as *Sinorhizobium, Rhizobium,* and *Mesorhizobium* that interact with plants naturally can be modified to mediate gene transfer to a number of diverse plants. These plant-associated symbiotic bacteria can be made competent for gene transfer by acquisition of both a disarmed Ti plasmid and a suitable binary vector (Broothaerts et al., 2005).

Methods for the creation of transgenic plants and expression of heterologous nucleic acids in plants in particular are known and may be used with the nucleic acids provided herein to prepare transgenic plants that exhibit reduced susceptibility to feeding by a target nematode. Plant transformation vectors can be prepared, for example, by inserting the dsRNA producing nucleic acids disclosed herein into plant transformation vectors and introducing these into plants. One known vector system has been derived by modifying the natural gene transfer system of *Agrobacterium tumefaciens*. The natural system comprises large Ti (tumor-inducing)-plasmids containing a large segment, known as T-DNA, which is transferred to transformed plants. Another segment of the Ti plasmid, the vir region, is responsible for T-DNA transfer. The T-DNA region is bordered by terminal repeats. In the modified binary vectors the tumor-inducing genes have been deleted and the functions of the vir region are utilized to transfer foreign DNA bordered by the T-DNA border sequences. The T-region may also contain a selectable marker for efficient recovery of transgenic plants and cells, and a multiple cloning site for inserting sequences for transfer such as a dsRNA encoding nucleic acid.

A transgenic plant formed using *Agrobacterium* transformation methods typically may contain a single simple recombinant DNA sequence inserted into one chromosome, referred to as a transgenic event. Such transgenic plants can be referred to as being heterozygous for the inserted exogenous sequence. A transgenic plant homozygous with respect to a transgene can be obtained by sexually mating (selfing) an independent segregant transgenic plant that contains a single exogenous gene sequence to itself, for example an $F_0$ plant, to produce $F_1$ seed. One fourth of the $F_1$ seed produced will be homozygous with respect to the transgene. Germinating $F_1$ seed results in plants that can be tested for heterozygosity, typically using a SNP assay or a thermal amplification assay that allows for the distinction between heterozygotes and homozygotes (i.e., a zygosity assay). Crossing a heterozygous plant with itself or another heterozygous plant results in heterozygous progeny, as well as homozygous transgenic and homozygous null progeny.

C. Nucleic Acid Expression and Target Gene Suppression

The present invention provides, as an example, a transformed host plant of a pathogenic target organism, transformed plant cells and transformed plants and their progeny. The transformed plant cells and transformed plants may be engineered to express one or more of the dsRNA or siRNA sequences, under the control of a heterologous promoter, described herein to provide a pathogen-protective effect. These sequences may be used for gene suppression in a pathogen, thereby reducing the level or incidence of disease caused by the pathogen on a protected transformed host organism. As used herein the words "gene suppression" are intended to refer to any of the well-known methods for reducing the levels of protein produced as a result of gene transcription to mRNA and subsequent translation of the mRNA.

Gene suppression is also intended to mean the reduction of protein expression from a gene or a coding sequence including posttranscriptional gene suppression and transcriptional suppression. Posttranscriptional gene suppression is mediated by the homology between of all or a part of a mRNA transcribed from a gene or coding sequence targeted for suppression and the corresponding double stranded RNA used for suppression, and refers to the substantial and measurable reduction of the amount of available mRNA available in the cell for binding by ribosomes or the prevention of translation by the ribosomes. The transcribed RNA can be in the sense orientation to effect what is called co-suppression, in the anti-sense orientation to effect what is called anti-sense suppression, or in both orientations producing a dsRNA to effect what is called RNA interference (RNAi).

Transcriptional suppression is mediated by the presence in the cell of a dsRNA gene suppression agent exhibiting substantial sequence identity to a promoter DNA sequence or the complement thereof to effect what is referred to as promoter trans suppression. Gene suppression may be effective against a native plant gene associated with a trait, e.g., to result in plants with reduced levels of a protein encoded by the native gene or with enhanced or reduced levels of an affected metabolite. Gene suppression can also be effective against target genes in a plant-parasitic nematode that may ingest or contact plant material containing gene suppression agents, specifically designed to inhibit or suppress the expression of one or more homologous or complementary sequences in the cells of the nematode. Post-transcriptional gene suppression by anti-sense or sense oriented RNA to regulate gene expression in plant cells is disclosed in U.S. Pat. Nos. 5,107,065, 5,759,829, 5,283,184, and 5,231,020. The use of dsRNA to suppress genes in plants is disclosed in WO 99/53050, WO 99/49029, U.S. Publication No. 2003/017596, U.S. Patent Application Publication 2004/0029283.

A beneficial method of post transcriptional gene suppression versus a plant-parasitic nematode employs both sense-oriented and anti-sense-oriented, transcribed RNA which is stabilized, e.g., as a hairpin or stem and loop structure. A preferred DNA construct for effecting post transcriptional gene suppression is one in which a first segment encodes an RNA exhibiting an anti-sense orientation exhibiting substantial identity to a segment of a gene targeted for suppression, which is linked to a second segment encoding an RNA exhibiting substantial complementarity to the first segment. Such a construct forms a stem and loop structure by hybridization of the first segment with the second segment and a loop structure from the nucleotide sequences linking the two segments (see WO94/01550, WO98/05770, US 2002/0048814, and US 2003/0018993). Co-expression with an additional target gene segment may also be employed, as noted above (e.g. WO05/019408).

According to one embodiment of the present invention, there is provided a nucleotide sequence, for which in vitro expression results in transcription of a stabilized RNA sequence that is substantially homologous to an RNA molecule of a targeted gene in a plant-parasitic nematode that comprises an RNA sequence encoded by a nucleotide sequence within the genome of the nematode. Thus, after the plant-parasitic nematode ingests the stabilized RNA sequence, a down-regulation of the nucleotide sequence corresponding to the target gene in the cells of a target nematode is affected.

In certain embodiments of the invention, expression of a fragment of at least 17, 18, 19, or 21 contiguous nucleotides of a nucleic acid sequence of any of SEQ ID NO:1-51 or SEQ ID NO:120-1064, or complements thereof, may be utilized, including expression of a fragment of up to 17, 18, 19, 20 or 21, 36, 60, 100, 550, or 1000 contiguous nucleotides, or sequences displaying 90-100% identity with such sequences, or their complements. In specific embodiments, a nucleotide provided by the invention may comprise a sequence selected from the group described in Table 4, including a location on such sequence spanning nucleotides as described in Table 4. In yet other embodiments, a nucleotide provided by the invention may be described as comprising one or more of nucleotides 1-21, 22-50, 51-100, 101-150, 151-200, 201-250, 251-300, 301-350, 351-400, 401-450, 451-500, 501-550, 551-600, 601-650, 651-700, 701-750, 751-800, 801-850, 851-

900, 901-950, 951-1000, 1001-1050, 1051-1100, 1101-1150, 1151-1200, 1201-1250, 1251-1300, 1301-1350, 1351-1400, 1401-1450, 1451-1500, 1501-1550, 1551-1600, 1601-1650, 1651-1700, 1701-1750, 1751-1800, 1801-1850, 1851-1900, 1901-1950, 1951-2000, 2001-2050, 2051-2100, 23-75, 76-125, 126-175, 176-225, 226-275, 276-325, 326-375, 376-425, 426-475, 476-525, 526-575, 576-625, 626-675, 676-725, 726-775, 776-825, 826-875, 876-925, 926-975, 976-1025, 1026-1075, 1076-1125, 1126-1175, 1176-1225, 1226-1275, 1276-1325, 1326-1375, 1376-1425, 1426-1475, 1476-1525, 1526-1575, 1576-1625, 1626-1675, 1676-1725, 1726-1775, 1776-1825, 1826-1875, 1876-1925, 1926-1975, 1976-2025, 2026-2075, 2076-2125, 1-550, 200-750, 300-850, 400-950, 500-1050, 600-1150, 700-1250, 800-1350, 900-1450, 1000-1550, 1100-1650, 1200-1750, 1300-1850, 1400-1950, 1500-2050, up to the full length of the sequence, of one or more of SEQ ID NO:1-51 or SEQ ID NO:120-1064. Methods for selecting specific sub-sequences as targets for siRNA-mediated gene suppression are known in the art (e.g. Reynolds et al., 2004).

Inhibition of a target gene using the stabilized dsRNA technology of the present invention is sequence-specific in that nucleotide sequences corresponding to the duplex region of the RNA are targeted for genetic inhibition. RNA containing a nucleotide sequences identical to a portion of the target gene transcript is preferred for inhibition. RNA sequences with insertions, deletions, and single point mutations relative to the target sequence have also been found to be effective for inhibition. In performance of the present invention, it is preferred that the inhibitory dsRNA and the portion of the target gene share at least from about 80% sequence identity, or from about 90% sequence identity, or from about 95% sequence identity, or from about 99% sequence identity, or even about 100% sequence identity. Alternatively, the duplex region of the RNA may be defined functionally as a nucleotide sequence that is capable of hybridizing with a portion of the target gene transcript. A less than full length sequence exhibiting a greater homology compensates for a longer less homologous sequence. The length of the identical nucleotide sequences may be at least about 19, 25, 50, 100, 200, 300, 400, 500 or at least about 1000 bases. Normally, a sequence of greater than 20-100 nucleotides should be used, though a sequence of greater than about 200-300 nucleotides would be preferred, and a sequence of greater than about 500-1000 nucleotides would be especially preferred depending on the size of the target gene. The invention has the advantage of being able to tolerate sequence variations that might be expected due to genetic mutation, strain polymorphism, or evolutionary divergence. The introduced nucleic acid molecule may not need to be absolutely homologous to the target sequence, and it may not need to be full length relative to either the primary transcription product or fully processed mRNA of the target gene. Therefore, those skilled in the art need to realize that, as disclosed herein, 100% sequence identity between the RNA and the target gene is not required to practice the present invention.

Inhibition of target gene expression may be quantified by measuring either the endogenous target RNA or the protein produced by translation of the target RNA and the consequences of inhibition can be confirmed by examination of the outward properties of the cell or organism. Techniques for quantifying RNA and proteins are well known to one of ordinary skill in the art.

In certain embodiments gene expression is inhibited by at least 10%, preferably by at least 33%, more preferably by at least 50%, and yet more preferably by at least 80%. In particularly preferred embodiments of the invention gene expression is inhibited by at least 80%, more preferably by at least 90%, more preferably by at least 95%, or by at least 99% within cells in the pathogen so a significant inhibition takes place. Significant inhibition is intended to refer to sufficient inhibition that results in a detectable phenotype (e.g., cessation of growth, feeding, development, reduced reproduction, mortality, etc.) or a detectable decrease in RNA and/or protein corresponding to the target gene being inhibited. Although in certain embodiments of the invention inhibition occurs in substantially all cells of the plant-parasitic nematode, in other preferred embodiments inhibition occurs in only a subset of cells expressing the gene.

DsRNA molecules may be synthesized either in vivo or in vitro. The dsRNA may be formed by a single self-complementary RNA strand or from two complementary RNA strands. Endogenous RNA polymerase of the cell may mediate transcription in vivo, or cloned RNA polymerase can be used for transcription in vivo or in vitro. Inhibition may be targeted by specific transcription in an organ, tissue, or cell type; stimulation of an environmental condition (e.g., infection, stress, temperature, chemical inducers); and/or engineering transcription at a developmental stage or age. The RNA strands may or may not be polyadenylated; the RNA strands may or may not be capable of being translated into a polypeptide by a cell's translational apparatus.

A RNA, dsRNA, siRNA, or miRNA of the present invention may be produced chemically or enzymatically by one skilled in the art through manual or automated reactions or in vivo in another organism. RNA may also be produced by partial or total organic synthesis; any modified ribonucleotide can be introduced by in vitro enzymatic or organic synthesis. The RNA may be synthesized by a cellular RNA polymerase or a bacteriophage RNA polymerase (e.g., T3, T7, SP6). The use and production of an expression construct are known in the art (see, for example, WO 97/32016; U.S. Pat. Nos. 5,593,874, 5,698,425, 5,712,135, 5,789,214, and 5,804,693). If synthesized chemically or by in vitro enzymatic synthesis, the RNA may be purified prior to introduction into the cell. For example, RNA can be purified from a mixture by extraction with a solvent or resin, precipitation, electrophoresis, chromatography, or a combination thereof. Alternatively, the RNA may be used with no or a minimum of purification to avoid losses due to sample processing. The RNA may be dried for storage or dissolved in an aqueous solution. The solution may contain buffers or salts to promote annealing, and/or stabilization of the duplex strands.

For transcription from a transgene in vivo or an expression construct, a regulatory region (e.g., promoter, enhancer, silencer, and polyadenylation) may be used to transcribe the RNA strand (or strands). Therefore, in one embodiment, the nucleotide sequences for use in producing RNA molecules may be operably linked to one or more promoter sequences functional in a microorganism, a fungus or a plant host cell. Ideally, the nucleotide sequences are placed under the control of an endogenous promoter, normally resident in the host genome. The nucleotide sequence of the present invention, under the control of an operably linked promoter sequence, may further be flanked by additional sequences that advantageously affect its transcription and/or the stability of a resulting transcript. Such sequences are generally located upstream of the operably linked promoter and/or downstream of the 3' end of the expression construct and may occur both upstream of the promoter and downstream of the 3' end of the expression construct, although such an upstream sequence only is also contemplated.

As used herein, the term "disease control agent", or "gene suppression agent" refers to a particular RNA molecule consisting of a first RNA segment and a second RNA segment linked by a third RNA segment. The first and the second RNA segments lie within the length of the RNA molecule and are substantially inverted repeats of each other and are linked together by the third RNA segment. The complementarity between the first and the second RNA segments results in the ability of the two segments to hybridize in vivo and in vitro to form a double stranded molecule, i.e., a stem, linked together at one end of each of the first and second segments by the third segment which forms a loop, so that the entire structure forms into a stem and loop structure, or even more tightly hybridizing structures may form into a stem-loop knotted structure. The first and the second segments correspond invariably, but not necessarily respectively, to a sense and an antisense sequence homologous with respect to the target RNA transcribed from the target gene in the target pathogen that is intended to be suppressed by the ingestion of the dsRNA molecule. The control agent can also be a substantially purified (or isolated) nucleic acid molecule and more specifically nucleic acid molecules or nucleic acid fragment molecules thereof from a genomic DNA (gDNA) or cDNA library. Alternatively, the fragments may comprise smaller oligonucleotides having from about 15 to about 250 nucleotide residues, and more preferably, about 15 to about 30 nucleotide residues.

As used herein, the term "genome" as it applies to cells of a plant-parasitic nematode or a host encompasses not only chromosomal DNA found within the nucleus, but organelle DNA found within subcellular components of the cell. The DNA's of the present invention introduced into plant cells can therefore be either chromosomally integrated or organelle-localized. The term "genome" as it applies to bacteria encompasses both the chromosome and plasmids within a bacterial host cell. The DNA's of the present invention introduced into bacterial host cells can therefore be either chromosomally integrated or plasmid-localized.

As used herein, the term "plant-parasitic nematode" refers to those nematodes that may infect, colonize, parasitize, or cause disease on host plant material transformed to express or coated with a double stranded gene suppression agent. As used herein, a "nematode resistance" trait is a characteristic of a transgenic plant, transgenic animal, or other transgenic host that causes the host to be resistant to attack from a nematode that typically is capable of inflicting damage or loss to the host. Such resistance can arise from a natural mutation or more typically from incorporation of recombinant DNA that confers plant-parasitic nematode resistance. To impart nematode resistance to a transgenic plant a recombinant DNA can, for example, be transcribed into a RNA molecule that forms a dsRNA molecule within the tissues or fluids of the recombinant plant. The dsRNA molecule is comprised in part of a segment of RNA that is identical to a corresponding RNA segment encoded from a DNA sequence within a plant-parasitic nematode that can cause disease on the host plant. Expression of the gene within the target plant-parasitic nematode is suppressed by the dsRNA, and the suppression of expression of the gene in the target plant-parasitic nematode results in the plant being resistant to the nematode.

The modulatory effect of dsRNA is applicable to a variety of genes expressed in the plant-parasitic nematode including, for example, endogenous genes responsible for cellular metabolism or cellular transformation, including housekeeping genes, transcription factors, molting-related genes, and other genes which encode polypeptides involved in cellular metabolism or normal growth and development.

As used herein, the phrase "inhibition of gene expression" or "inhibiting expression of a target gene in the cell of a plant-parasitic nematode" refers to the absence (or observable decrease in the level) of protein and/or mRNA product from the target gene. Specificity refers to the ability to inhibit the target gene without direct effects on other genes of the cell and without any direct effects on any gene within the cell that is producing the dsRNA molecule. The inhibition of gene expression of the target gene in the plant-parasitic nematode may result in novel phenotypic traits in the nematode.

The present invention provides in part a delivery system for the delivery of the nematode control agents by ingestion of host cells or the contents of the cells. In accordance with another embodiment, the present invention involves generating a transgenic plant cell or a plant that contains a recombinant DNA construct transcribing the stabilized dsRNA molecules of the present invention. As used herein, "taking up" refers to the process of an agent coming in contact with cells of a target organism, such as a nematode. This may occur, for instance, by nematode feeding, by soaking, or by injection. As used herein, the phrase "generating a transgenic plant cell or a plant" refers to the methods of employing the recombinant DNA technologies readily available in the art (e.g., by Sambrook, et al., 1989) to construct a plant transformation vector transcribing the stabilized dsRNA molecules of the present invention, to transform the plant cell or the plant and to generate the transgenic plant cell or the transgenic plant that contain the transcribed, stabilized dsRNA molecules.

It is envisioned that the compositions of the present invention can be incorporated within the seeds of a plant species either as a product of expression from a recombinant gene incorporated into a genome of the plant cells, or incorporated into a coating or seed treatment that is applied to the seed before planting. The plant cell containing a recombinant gene is considered herein to be a transgenic event.

The present invention provides in part a delivery system for the delivery of disease control agents to plant-parasitic nematodes. The stabilized dsRNA or siRNA molecules of the present invention may be directly introduced into the cells of a plant-parasitic nematode. Methods for introduction may include direct mixing of RNA with host tissue for the plant-parasitic nematode, as well as engineered approaches in which a species that is a host is engineered to express the dsRNA or siRNA. In one embodiment, the RNA may be sprayed onto a plant surface. In still another embodiment, the dsRNA or siRNA may be expressed by microorganisms and the microorganisms may be applied onto a plant surface or introduced into a root, stem by a physical means such as an injection. In still another embodiment, a plant may be genetically engineered to express the dsRNA or siRNA in an amount sufficient to kill the plant-parasitic nematodes known to infest the plant.

It is also anticipated that dsRNAs produced by chemical or enzymatic synthesis may be formulated in a manner consistent with common agricultural practices and used as spray-on products for controlling plant disease. The formulations may include the appropriate stickers and wetters required for efficient foliar coverage as well as UV protectants to protect dsRNAs from UV damage. Such additives are commonly used in the bioinsecticide industry and are well known to those skilled in the art. Such applications could be combined with other spray-on insecticide applications, biologically based or not, to enhance plant protection from plant-parasitic nematodes The present invention also relates to recombinant DNA constructs for expression in a microorganism. Exogenous nucleic acids from which an RNA of interest is transcribed can be introduced into a microbial host cell, such as a bacterial cell or a fungal cell, using methods known in the art.

The nucleotide sequences of the present invention may be introduced into a wide variety of prokaryotic and eukaryotic microorganism hosts to produce the stabilized dsRNA or siRNA molecules. The term "microorganism" includes prokaryotic and eukaryotic species such as bacteria and fungi, as well as nematodes. Fungi include yeasts and filamentous fungi, among others. Illustrative prokaryotes, both Gram-negative and Gram-positive, include Enterobacteriaceae, such as *Escherichia, Erwinia*, and *Serratia*; Bacillaceae; Rhizobiaceae, such as *Rhizobium*; Spirillaceae, such as *photobacterium, Zymomonas*; Lactobacillaceae; Pseudomonadaceae, such as *Pseudomonas* and *Acetobacter*; Azotobacteraceae, Actinomycetales, and Nitrobacteraceae. Among eukaryotes are fungi, such as Phycomycetes and Ascomycetes, including *Saccharomyces* and *Schizosaccharomyces*; and Basidiomycetes, such as *Rhodotorula, Aureobasidium*, and the like.

D. Transgenic Plants and Cells

Hairy roots are characterized by fast growth, frequent branching, plagiotropism. Hairy roots serve as a strong model for whole roots, as they retain the ability to synthesize compounds similarly to the roots of the intact plant (David et al. 1984). Methods for transfer and integration of the genes located on the root-inducing plasmid Ri of *Agrobacterium rhizogenes* into the plant genome and their expression therein are well established (White and Nester, 1980). These types of roots continue to grow in vitro on hormone-free medium and also exhibit a high degree of genetic stability (Aird et al. 1988). The natural ability of the soil bacterium *A. rhizogenes* to transform genes into a host plant genome results in roots being formed at the site of infection, and is used to produce hairy root cultures. Infection of the plant with *A. rhizogenes* strain R-1000, leads to the integration and expression of T-DNA in the plant genome, which causes development of a hairy roots. Hairy root cultures grow rapidly, show plagiotropic root growth and are highly branched on hormone-free medium. Transgenic hairy roots induced by *Agrobacterium rhizogenes* support the complete life cycle of root lesion nematodes ("RLN"; *Pratylenchus* spp.) in vitro, and allow the rapid growth of tissue on a large scale which can be used for the identification and isolation of genes of interest. Hairy roots were initiated from soybean or tomato plants as described below, and in accordance with knowledge in the art.

The present invention provides seeds and plants having one or more transgenic events. Combinations of events are referred to as "stacked" transgenic events. These stacked transgenic events can be events that are directed at the same target organism, or they can be directed at different target pathogens or pests. In one embodiment, a seed having the ability to express a nucleic acid provided herein also has the ability to express at least one other agent, including, but not limited to, an RNA molecule the sequence of which is derived from the sequence of an RNA expressed in a target pathogen such as a nematode and that forms a double stranded RNA structure upon expressing in the seed or cells of a plant grown from the seed, wherein the ingestion of one or more cells of the plant by the target results in the suppression of expression of the RNA in the cells of the target.

In certain embodiments, a seed having the ability to express a dsRNA the sequence of which is derived from a target plant-parasitic nematode also has a "stacked" transgenic event that provides herbicide tolerance. One beneficial example of a herbicide tolerance gene provides resistance to glyphosate, N-(phosphonomethyl) glycine, including the isopropylamine salt form of such herbicide.

Benefits provided by the present invention may include, but are not limited to: the ease of introducing dsRNA into the plant-parasitic nematode cells, the low concentration of dsRNA which can be used, the stability of dsRNA, and the effectiveness of the inhibition. The ability to use a low concentration of a stabilized dsRNA avoids several disadvantages of anti-sense interference. The present invention is not limited to in vitro use or to specific sequence compositions, to a particular set of target genes, a particular portion of the target gene's nucleotide sequence, or a particular transgene or to a particular delivery method, as opposed to the some of the available techniques known in the art, such as antisense and co-suppression. Furthermore, genetic manipulation becomes possible in organisms that are not classical genetic models.

In order to achieve selective inhibition of a target gene within a plant-parasitic nematode species that it is desired to control, the target gene should generally exhibit a low degree of sequence identity with corresponding genes in a plant or a vertebrate animal. Preferably the degree of the sequence identity is less than approximately 80%. More preferably the degree of the sequence identity is less than approximately 70%. Most preferably the degree of the sequence identity is less than approximately 60%.

In addition to direct transformation of a plant with a recombinant DNA construct, transgenic plants can be prepared by crossing a first plant having a recombinant DNA construct with a second plant lacking the construct. For example, recombinant DNA for gene suppression can be introduced into first plant line that is amenable to transformation to produce a transgenic plant that can be crossed with a second plant line to introgress the recombinant DNA for gene suppression into the second plant line.

The present invention can be, in practice, combined with other disease control traits in a plant to achieve desired traits for enhanced control of plant disease. Combining disease control traits that employ distinct modes-of-action can provide protected transgenic plants with superior durability over plants harboring a single control trait because of the reduced probability that resistance will develop in the field.

The invention also relates to commodity products containing one or more of the sequences of the present invention, and produced from a recombinant plant or seed containing one or more of the nucleotide sequences of the present invention are specifically contemplated as embodiments of the present invention. A commodity product containing one or more of the sequences of the present invention is intended to include, but not be limited to, meals, oils, crushed or whole grains or seeds of a plant, or any food product comprising any meal, oil, or crushed or whole grain of a recombinant plant or seed containing one or more of the sequences of the present invention. The detection of one or more of the sequences of the present invention in one or more commodity or commodity products contemplated herein is defacto evidence that the commodity or commodity product is composed of a transgenic plant designed to express one or more of the nucleotides sequences of the present invention for the purpose of controlling plant disease using dsRNA mediated gene suppression methods.

E. Obtaining Nucleic acids

The present invention provides methods for obtaining a nucleic acid comprising a nucleotide sequence for producing a dsRNA or siRNA. In one embodiment, such a method comprises: (a) analyzing one or more target gene(s) for their expression, function, and phenotype upon dsRNA-mediated gene suppression in a nematode; (b) probing a cDNA or gDNA library with a hybridization probe comprising all or a portion of a nucleotide sequence or a homolog thereof from a targeted nematode that displays an altered, e.g. reduced, nematode growth, development, or reproduction phenotype in a dsRNA-mediated suppression analysis; (c) identifying a DNA clone that hybridizes with the hybridization probe; (d) isolating the DNA clone identified in step (b); and (e) sequencing the cDNA or gDNA fragment that comprises the clone isolated in step (d) wherein the sequenced nucleic acid molecule transcribes all or a substantial portion of the RNA nucleotide acid sequence or a homolog thereof.

In another embodiment, a method of the present invention for obtaining a nucleic acid fragment comprising a nucleotide sequence for producing a substantial portion of a dsRNA or siRNA comprises: (a) synthesizing a first and a second oligonucleotide primers corresponding to a portion of one of the nucleotide sequences from a targeted pathogen; and (b) amplifying a cDNA or gDNA insert present in a cloning vector using the first and second oligonucleotide primers of step (a) wherein the amplified nucleic acid molecule transcribes a substantial portion of the a substantial portion of a dsRNA or siRNA of the present invention.

In practicing the present invention, a target gene may be derived from *M. incognita* or another nematode. It is contemplated that several criteria may be employed in the selection of preferred target genes. The *Pratylenchus* spp. gene may be one which has a *C. elegans* ortholog with a high likelihood for a strong phenotype upon RNAi knockdown of expression, including a P0 phenotype. Such targets are often those with protein products involved in core cellular processes such as DNA replication, cell cycle, transcription, RNA processing, translation, protein trafficking, secretion, protein modification, protein stability and degradation, energy production, intermediary metabolism, cell structure, signal transduction, channels and transporters, and endocytosis. In certain embodiments it is advantageous to select a gene for which a small drop in expression level results in deleterious effects for the pathogen. Of particular interest are *Pratylenchus* genes with RNAi validated orthologs in other tylenchid nematodes (e.g., soybean cyst nematode).

As used herein, the term "derived from" refers to a specified nucleotide sequence that may be obtained from a particular specified source or species, albeit not necessarily directly from that specified source or species.

In one embodiment, a gene is selected that is essentially involved in the growth, development, or reproduction of a plant-parasitic nematode. Other target genes for use in the present invention may include, for example, those that play important roles in nematode viability, growth, development, infectivity, and establishment of productively feeding nematodes. These target genes may be one of the house keeping genes, transcription factors and the like. Additionally, the nucleotide sequences for use in the present invention may also be derived from homologs, including orthologs, of plant, viral, bacterial or insect genes whose functions have been established from literature and the nucleotide sequences of which share substantial similarity with the target genes in the genome of a target nematode. According to one aspect of the present invention for nematode control, the target sequences may essentially be derived from the targeted plant-parasitic nematode. Some of the exemplary target sequences cloned from a nematode that encode proteins or fragments thereof which are homologues or orthologs of known proteins may be found in the Sequence Listing, for instance in SEQ ID NO:1-51 or SEQ ID NO:120-1064.

For the purpose of the present invention, the dsRNA or siRNA molecules may be obtained by polymerase chain (PCR) amplification of a target gene sequences derived from a gDNA or cDNA library or portions thereof. The DNA library may be prepared using methods known to the ordinary skilled in the art and DNA/RNA may be extracted. Genomic DNA or cDNA libraries generated from a target organism may be used for PCR amplification for production of the dsRNA or siRNA.

The target gene sequences may be then be PCR amplified and sequenced using the methods readily available in the art. One skilled in the art may be able to modify the PCR conditions to ensure optimal PCR product formation. The confirmed PCR product may be used as a template for in vitro transcription to generate sense and antisense RNA with the included minimal promoters. In one embodiment, the present invention comprises isolated and purified nucleotide sequences that may be used as plant-parasitic nematode control agents. The isolated and purified nucleotide sequences may comprise those as set forth in the sequence listing.

As used herein, the phrase "coding sequence", "structural nucleotide sequence" or "structural nucleic acid molecule" refers to a nucleotide sequence that is translated into a polypeptide, usually via mRNA, when placed under the control of appropriate regulatory sequences. The boundaries of the coding sequence are determined by a translation start codon at the 5'-terminus and a translation stop codon at the 3'-terminus. A coding sequence can include, but is not limited to, genomic DNA, cDNA, EST and recombinant nucleotide sequences.

The term "recombinant DNA" or "recombinant nucleotide sequence" refers to DNA that contains a genetically engineered modification through manipulation via mutagenesis, restriction enzymes, and the like.

For many of the plant-parasitic nematodes that are potential targets for control by the present invention, there may be limited information regarding the sequences of most genes or the phenotype resulting from mutation of particular genes. Therefore, it is contemplated that selection of appropriate genes for use in the present invention may be accomplished through use of information available from study of the corresponding genes in a model organism such in *C. elegans*, in which the genes have been characterized, according to the analysis described in Examples 1-8. In some cases it will be possible to obtain the sequence of a corresponding gene from a target nematode by searching databases such as GenBank using either the name of the gene or the sequence from, for example, a nematode from which the gene has been cloned. Once the sequence is obtained, PCR may be used to amplify an appropriately selected segment of the gene in the target nematode for use in the present invention. PCR primers may be designed based on the sequence as found in another organism from which the gene has been cloned. The primers are designed to amplify a DNA segment of sufficient length for use in the present invention. DNA (either genomic DNA or cDNA) is prepared from the target plant-parasitic nematode, and the PCR primers are used to amplify the DNA segment. Amplification conditions are selected so that amplification will occur even if the primers do not exactly match the target sequence. Alternately, the gene (or a portion thereof) may be cloned from a gDNA or cDNA library prepared from a plant-parasitic nematode species, using the known gene as a probe. Techniques for performing PCR and cloning from libraries are known. Further details of the process by which DNA segments from target plant-parasitic nematodes species may be isolated based on the sequence of genes previously cloned from other species are provided in the Examples. One of ordinary skill in the art will recognize that a variety of techniques may be used to isolate gene segments from plant-parasitic nematodes that correspond to genes previously isolated from other species.

EXAMPLES

The inventors herein have identified a means for controlling plant-parasitic nematodes by providing double stranded ribonucleic acid molecules to plant-parasitic nematodes, and a means to select sequences that encode these double stranded ribonucleic acid molecules. Double stranded ribonucleic acid molecules that function upon ingestion to inhibit a biological function in a nematode may result, for example, in one or more of the following attributes: reduction in growth of a nematode, inhibition of development of a nematode, or reduction of viability or egg production. Any one or any combination of these attributes can result in an effective inhibition of plant infection or colonization, and in the case of a plant pathogenic nematode, inhibition of plant disease, and/or reduction in severity of disease symptoms.

Example 1

Hairy Root Generation Protocols

For soybean Williams 82 hairy roots, *A. rhizogenes* strain K599 (NCPPB 2659; NCPPB, Sand Hutton, York, UK) was grown and maintained on LB (Luria Bertani), or yeast extract and peptone (YEP) media. Yeast extract is the water-soluble portion of autolyzed yeast. The autolysis is carefully controlled to preserve naturally occurring B-complex vitamins. Yeast extract is typically prepared by growing baker's yeast, *Saccharomyces* spp., in a carbohydrate-rich plant medium. The yeast is harvested, washed, and resuspended in water, where it undergoes autolysis, i.e., self-digestion using the yeast's enzymes. Yeast extract is the total soluble portion of this autolytic action. The autolytic activity is stopped by a heating step. The resulting yeast extract is filtered clear and dried into a powder by spray drying. Methods for generation of transgenic tomato Mountain Spring (susceptible) or Fresh Mountain Plus (resistant) hairy root cultures using *A. rhizogenes* strain D1 are similar, except that MgL media containing yeast extract, NaCl, tryptone, L-glutamic acid, potassium phosphate, magnesium sulfate and biotin is used. Soybean seeds were surface-sterilized by contacting with chlorine gas under controlled conditions for 12-16 hours, followed by aeration in a clean air hood for at least 30 minutes. Seeds were germinated in Petri dishes containing ¼ MS (Murashige & Skoog, 1962). The hypocotyl or cotyledons of 6-day-old seedlings were wounded using a scalpel, and wounded cotyledons were then immersed in a culture of freshly grown *A. rhizogenes* containing a DNA construct of interest, and vacuum infiltrated. Cotyledons were cultured under similar conditions used for seed germination with the exception that the antibiotic cefotaxime is added to the ¼ MS agar plates to prevent subsequent overgrowth by *A. rhizogenes*. Adventitious roots were excised from hypocotyls or cotyledons inoculated with *A. rhizogenes*. The putative transformed roots were cultured on Gamborg's B-5 agar (Gamborg et al., 1976) containing 3% sucrose plus 3 g/l Gelrite®, BASTA, and cefotaxime). Roots surviving selection were transferred to fresh media and maintained on Gamborg's B-5 agar in an incubator, without light, at about 24-30° C. A piece of root tip was typically excised and transferred to fresh medium every 2-4 weeks.

Example 2

Nematode Bioassays on Hairy Root Material

Following hairy root line selection, roots for plant nematode bioassays were transferred to fresh plates containing Gamborg's B-5 medium and allowed to grow for approximately two weeks to provide sufficient tissue for nematode infection before inoculation with a mixed-stage innoculum of root lesion nematodes (RLN). Individual hairy root tips were placed on infection plates. Typically, about 20 plates were used for pathogenicity testing of transformed roots for reaction to lesion nematodes. Each plate contained a transformed root from a separate integration. An additional 20 plates containing a transformed (empty vector) and transformed wild type dsRNA (e.g., GFP) are included in the tests. The protocol utilized was essentially that of Narayanan et al., 1999, with minor modifications. Plates are inoculated with approximately approximately 400 sterile lesion and incubated at 30° C. For lesion nematodes plates are harvested after approximately 56 days by placing roots in glass bowls filled with sterilized water containing 50 mg/L carbenicillin and 50 mg/L kanamycin. After 9-10 days to allow the worms to exit the roots, the solution is poured off and the worms counted under a microscope. To determine weighs, roots bowls are then micro-waved to melt the agar and the roots are collected with sieve. The extra water is absorbed with a paper towel and the root weights recorded.

Sterile lesion larvae are prepared from lesion nematodes grown on corn explant plates. The nematodes are harvested be putting the roots with medium onto filter paper supported by a wire sieve in a sterilized glass bowl, which has been filled with sterilized water containing 50 mg/L carbenicillin and 50 mg/L kanamycin. The amount of the water is enough to just submerge the agar. The bowls are stored at room temperature (25° C.) for two days. The sieve is removed and the solution poured into a 50 ml conical tube, which was then centrifuged for 5 minutes at 3500 g at room temperature. The tube is then let to sit for 15 minutes to allow the worms to set to the bottom of the tube and the supernatant sucked out with a sterilized one ml tip connected to a vacuum. Sterilized water is then added to the worms containing 12 mg/L of the antifungal compound Imazilil and 50 mg/L kanamycin.

Example 3

Root Lesion Nematode Target Genes Suitable for Broad Spectrum Control of *Pratylenchus* Species Through RNA Interference Table 1 describes essential nematode gene nucleotide sequences (predicted or encoded polypeptides are listed in Table 2) that are conserved, essential and sensitive targets that facilitate RNAi-based broad spectrum control of *Pratylenchus* spp. These genes can nonetheless be targeted without off target effects due to sufficient nucleotide divergence from essential genes in non-target organisms such as humans, host plant species and beneficial insects like bees that may come in contact with plant material expressing dsRNAs.

To identify *Pratylenchus* orthologs of characterized *C. elegans* genes, homology searches were performed using the BLAST suite of programs (Altschul et al., 1990). Using predicted protein sequences for *C. elegans* genes (Wormpep) TBLASTN was used to search proprietary 454 draft genomes of *P. scribneri* and *P. zeae*. Bitscore, e-value, and % identity were tracked. For consideration as a target, a *C. elegans* gene had to have a TBLASTN match to an ortholog or homolog in *P. scribneri* or *P. zeae* with an e-value of at least e-10 or better. Starting with lesion homologs of RNAi positive *C. elegans* genes, a number of computational screens were used to prioritize gene targets with the highest likelihood of being sensitive to perturbation by RNAi and being important to the lifecycle of lesion nematodes. Related nucleic acid sequences from *P. penetrans* and *P. brachyurus* were cloned by polymerase chain reaction (PCR) using degenerate primers and/or conserved primers as well as using rapid amplification of cDNA ends (RACE) and inverse PCR techniques.

TABLE 1

| | | Nucleotide root lesion nematode target sequences |
|---|---|---|
| SEQ ID NO: 1 | *P. scribneri* top-1 cDNA | nucleotide homolog of *C. elegans* M01E5.5b |
| SEQ ID NO: 2 | *P. scribneri* kin-2 cDNA | nucleotide homolog of *C. elegans* R07E4.6 |
| SEQ ID NO: 3 | *P. scribneri* cgh-1 cDNA | homolog of *C. elegans* C07H6.5 |
| SEQ ID NO: 4 | *P. brachyurus* top-1 cDNA | homolog of *C. elegans* M01E5.5b |
| SEQ ID NO: 5 | *P. brachyurus* kin-2 cDNA | homolog of *C. elegans* R07E4.6 |
| SEQ ID NO: 6 | *P. brachyurus* cgh-1 cDNA | homolog of *C. elegans* C07H6.5 |
| SEQ ID NO: 7 | *P. zeae* top-1 cDNA | homolog of *C. elegans* M01E5.5b |
| SEQ ID NO: 8 | *P. zeae* kin-2 cDNA | homolog of *C. elegans* R07E4.6 |
| SEQ ID NO: 9 | *P. zeae* cgh-1 cDNA | homolog of *C. elegans* C07H6.5 |
| SEQ ID NO: 10 | *P. penetrans* partial top-1 cDNA | homolog of *C. elegans* M01E5.5b |
| SEQ ID NO: 11 | *P. penetrans* partial kin-2 cDNA | homolog of *C. elegans* R07E4.6 |
| SEQ ID NO: 12 | *P. penetrans* partial cgh-1 cDNA | homolog of *C. elegans* C07H6.5 |
| SEQ ID NO: 13 | *P. scribneri* cpl-1 allelle 1 cDNA | homolog of *C. elegans* T03E6.7 |
| SEQ ID NO: 14 | *P. scribneri* cpl-1 allelle 2 cDNA | homolog of *C. elegans* T03E6.7 |
| SEQ ID NO: 15 | *P. scribneri* T26G10.1 cDNA | homolog of *C. elegans* T26G10.1 |
| SEQ ID NO: 16 | *P. scribneri* uba-1 cDNA | homolog of *C. elegans* C47E12.5 |
| SEQ ID NO: 17 | *P. scribneri* vha-15 cDNA | homolog of *C. elegans* T14F9.1 |
| SEQ ID NO: 18 | *P. scribneri* pap-1 cDNA | homolog of *C. elegans* Y32F6A.3 |
| SEQ ID NO: 19 | *P. scribneri* sec61 cDNA | homolog of *C. elegans* Y57G11C.15 |
| SEQ ID NO: 20 | *P. scribneri* partial vab-10 cDNA | homolog of *C. elegans* ZK1151.1 |
| SEQ ID NO: 21 | *P. scribneri* partial noah-1cDNA | homolog of *C. elegans* C34G6.6 |
| SEQ ID NO: 22 | *P. scribneri* prp-17 cDNA | homolog of *C. elegans* F49D11.1 |
| SEQ ID NO: 23 | *P. scribneri* let-767 cDNA | homolog of *C. elegans* C56G2.6 |
| SEQ ID NO: 24 | *P. scribneri* pas-6 cDNA | homolog of *C. elegans* CD4.6 |
| SEQ ID NO: 25 | *P. scribneri* partial vha-13 cDNA | homolog of *C. elegans* Y49A3A.2 |
| SEQ ID NO: 26 | *P. scribneri* partial rbp-2 cDNA | homolog of *C. elegans* C26E6.4 |
| SEQ ID NO: 27 | *P. scribneri* partial noah-2 cDNA | homolog of *C. elegans* F52B11.3 |
| SEQ ID NO: 28 | *P. scribneri* tkt-1 cDNA | homolog of *C. elegans* F01G10.1 |
| SEQ ID NO: 29 | *P. scribneri* partial nhr-23 cDNA | homolog of *C. elegans* C01H6.5 |
| SEQ ID NO: 30 | *P. scribneri* partial nuo-4 cDNA | homolog of *C. elegans* K04G7.4 |
| SEQ ID NO: 31 | *P. scribneri* vha-19 cDNA | homolog of *C. elegans* Y55H10A.1 |
| SEQ ID NO: 32 | *P. scribneri* aps-1 cDNA | homolog of *C. elegans* F29G9.3 |
| SEQ ID NO: 33 | *P. zeae* partial T26G10.1 cDNA | homolog of *C. elegans* T26G10.1 |
| SEQ ID NO: 34 | *P. zeae* sec61 cDNA | homolog of *C. elegans* Y57G11C.15 |
| SEQ ID NO: 35 | *P. zeae* uba-1 cDNA | homolog of *C. elegans* C47E12.5 |
| SEQ ID NO: 36 | *P. zeae* partial vab-10 cDNA | homolog of *C. elegans* ZK1151.1 |
| SEQ ID NO: 37 | *P. zeae* partial vha-15 cDNA | homolog of *C. elegans* T14F9.1 |
| SEQ ID NO: 38 | *P. zeae* partial noah-1cDNA | homolog of *C. elegans* C34G6.6 |
| SEQ ID NO: 39 | *P. zeae* prp-17 cDNA | homolog of *C. elegans* F49D11.1 |
| SEQ ID NO: 40 | *P. zeae* partial let-767 cDNA | homolog of *C. elegans* C56G2.6 |
| SEQ ID NO: 41 | *P. zeae* partial pas-6 cDNA | homolog of *C. elegans* CD4.6 |
| SEQ ID NO: 42 | *P. zeae* partial vha-13 cDNA | homolog of *C. elegans* Y49A3A.2 |
| SEQ ID NO: 43 | *P. zeae* partial rbp-2 cDNA | homolog of *C. elegans* C26E6.4 |
| SEQ ID NO: 44 | *P. zeae* partial noah-2 cDNA | homolog of *C. elegans* F52B11.3 |
| SEQ ID NO: 45 | *P. zeae* tkt-1 cDNA | homolog of *C. elegans* F01G10.1 |
| SEQ ID NO: 46 | *P. zeae* partial nhr-23 cDNA | homolog of *C. elegans* C01H6.5 |
| SEQ ID NO: 47 | *P. zeae* partial pap-1 cDNA | homolog of *C. elegans* Y32F6A.3 |
| SEQ ID NO: 48 | *P. zeae* partial nuo-4 cDNA | homolog of *C. elegans* K04G7.4 |
| SEQ ID NO: 49 | *P. zeae* vha-19 cDNA | homolog of *C. elegans* Y55H10A.1 |
| SEQ ID NO: 50 | *P. zeae* aps-1 cDNA | homolog of *C. elegans* F29G9.3 |
| SEQ ID NO: 51 | *P. zeae* partial prp-21 cDNA | homolog of *C. elegans* W07E6.4 |

The sequences listed in Table 1 were used to search for similar (e.g. orthologous or homologous) EST and other sequences in various *Pratylenchus* spp. in Genbank with the following results:

SEQ ID NO: 1-51 No matches to *Pratylenchus* ESTs or cDNAs in Genbank

TABLE 2

| | | Root lesion nematode amino acid sequences |
|---|---|---|
| SEQ ID NO: 52 | *P. scribneri* top-1 ORF | nucleotide homolog of *C. elegans* M01E5.5b |
| SEQ ID NO: 53 | *P. scribneri* kin-2 ORF | nucleotide homolog of *C. elegans* R07E4.6 |
| SEQ ID NO: 54 | *P. scribneri* cgh-1 ORF | homolog of *C. elegans* C07H6.5 |
| SEQ ID NO: 55 | *P. brachyurus* top-1 ORF | homolog of *C. elegans* M01E5.5b |
| SEQ ID NO: 56 | *P. brachyurus* kin-2 ORF | homolog of *C. elegans* R07E4.6 |
| SEQ ID NO: 57 | *P. brachyurus* cgh-1 ORF | homolog of *C. elegans* C07H6.5 |
| SEQ ID NO: 58 | *P. zeae* top-1 ORF | homolog of *C. elegans* M01E5.5b |
| SEQ ID NO: 59 | *P. zeae* kin-2 ORF | homolog of *C. elegans* R07E4.6 |
| SEQ ID NO: 60 | *P. zeae* cgh-1 ORF | homolog of *C. elegans* C07H6.5 |
| SEQ ID NO: 61 | *P. penetrans* partial top-1 ORF | homolog of *C. elegans* M01E5.5b |
| SEQ ID NO: 62 | *P. penetrans* partial kin-2 ORF | homolog of *C. elegans* R07E4.6 |
| SEQ ID NO: 63 | *P. penetrans* partial cgh-1 ORF | homolog of *C. elegans* C07H6.5 |

TABLE 2-continued

Root lesion nematode amino acid sequences

| SEQ ID NO: 64 | P. scribneri cpl-1 allelle 1 ORF | homolog of C. elegans T03E6.7 |
| SEQ ID NO: 65 | P. scribneri cpl-1 allelle 2 ORF | homolog of C. elegans T03E6.7 |
| SEQ ID NO: 66 | P. scribneri T26G10.1 ORF | homolog of C. elegans T26G10.1 |
| SEQ ID NO: 67 | P. scribneri uba-1 ORF | homolog of C. elegans C47E12.5 |
| SEQ ID NO: 68 | P. scribneri vha-15 ORF | homolog of C. elegans T14F9.1 |
| SEQ ID NO: 69 | P. scribneri pap-1 ORF | homolog of C. elegans Y32F6A.3 |
| SEQ ID NO: 70 | P. scribneri sec61 ORF | homolog of C. elegans Y57G11C.15 |
| SEQ ID NO: 71 | P. scribneri partial vab-10 ORF | homolog of C. elegans ZK1151.1 |
| SEQ ID NO: 72 | P. scribneri partial noah-1 ORF | homolog of C. elegans C34G6.6 |
| SEQ ID NO: 73 | P. scribneri prp-17 ORF | homolog of C. elegans F49D11.1 |
| SEQ ID NO: 74 | P. scribneri let-767 ORF | homolog of C. elegans C56G2.6 |
| SEQ ID NO: 75 | P. scribneri pas-6 ORF | homolog of C. elegans CD4.6 |
| SEQ ID NO: 76 | P. scribneri partial vha-13 ORF | homolog of C. elegans Y49A3A.2 |
| SEQ ID NO: 77 | P. scribneri partial rbp-2 ORF | homolog of C. elegans C26E6.4 |
| SEQ ID NO: 78 | P. scribneri partial noah-2 ORF | homolog of C. elegans F52B11.3 |
| SEQ ID NO: 79 | P. scribneri tkt-1 ORF | homolog of C. elegans F01G10.1 |
| SEQ ID NO: 80 | P. scribneri partial nhr-23 ORF | homolog of C. elegans C01H6.5 |
| SEQ ID NO: 81 | P. scribneri partial nuo-4 ORF | homolog of C. elegans K04G7.4 |
| SEQ ID NO: 82 | P. scribneri vha-19 ORF | homolog of C. elegans Y55H10A.1 |
| SEQ ID NO: 83 | P. scribneri aps-1 ORF | homolog of C. elegans F29G9.3 |
| SEQ ID NO: 84 | P. zeae partial T26G10.1 ORF | homolog of C. elegans T26G10.1 |
| SEQ ID NO: 85 | P. zeae sec61 ORF | homolog of C. elegans Y57G11C.15 |
| SEQ ID NO: 86 | P. zeae uba-1 ORF | homolog of C. elegans C47E12.5 |
| SEQ ID NO: 87 | P. zeae partial vab-10 ORF | homolog of C. elegans ZK1151.1 |
| SEQ ID NO: 88 | P. zeae partial vha-15 ORF | homolog of C. elegans T14F9.1 |
| SEQ ID NO: 89 | P. zeae partial noah-1 ORF | homolog of C. elegans C34G6.6 |
| SEQ ID NO: 90 | P. zeae prp-17 ORF | homolog of C. elegans F49D11.1 |
| SEQ ID NO: 91 | P. zeae partial let-767 ORF | homolog of C. elegans C56G2.6 |
| SEQ ID NO: 92 | P. zeae partial pas-6 ORF | homolog of C. elegans CD4.6 |
| SEQ ID NO: 93 | P. zeae partial vha-13 ORF | homolog of C. elegans Y49A3A.2 |
| SEQ ID NO: 94 | P. zeae partial rbp-2 ORF | homolog of C. elegans C26E6.4 |
| SEQ ID NO: 95 | P. zeae partial noah-2 ORF | homolog of C. elegans F52B11.3 |
| SEQ ID NO: 96 | P. zeae tkt-1 ORF | homolog of C. elegans F01G10.1 |
| SEQ ID NO: 97 | P. zeae partial nhr-23 ORF | homolog of C. elegans C01H6.5 |
| SEQ ID NO: 98 | P. zeae partial pap-1 ORF | homolog of C. elegans Y32F6A.3 |
| SEQ ID NO: 99 | P. zeae partial nuo-4 ORF | homolog of C. elegans K04G7.4 |
| SEQ ID NO: 100 | P. zeae vha-19 ORF | homolog of C. elegans Y55H10A.1 |
| SEQ ID NO: 101 | P. zeae aps-1 ORF | homolog of C. elegans F29G9.3 |
| SEQ ID NO: 102 | P. zeae partial prp-21 ORF | homolog of C. elegans W07E6.4 |

Table 2 lists the predicted amino acid sequences encoded by the nucleotide sequences of Table 1.

The amino acid sequences of Table 2 were compared with presumed orthologous or homologous amino acid sequences in various nematode species, as follows:

SEQ ID NO: 52 has the following amino acid identity to its nematode orthologs, 59% B. malayi, 60-67% C. elegans, 67% C. briggsae, 71% C. brenneri.

SEQ ID NO: 53 has the following amino acid identity to its nematode orthologs, 79% O. volvulus, 79% B. malayi, 72-76% C. elegans, 76% C. briggsae.

SEQ ID NO: 54 has the following amino acid identity to its nematode orthologs, 80% B. malayi, 81% C. elegans, 82% C. briggsae.

SEQ ID NO: 55 has the following amino acid identity to its nematode orthologs, 73% B. malayi, 66% C. elegans, 66% C. briggsae, 68% C. brenneri.

SEQ ID NO: 56 has the following amino acid identity to its nematode orthologs, 78% O. volvulus, 76% B. malayi, 70-74% C. elegans, 74% C. briggsae.

SEQ ID NO: 57 has the following amino acid identity to its nematode orthologs, 80% B. malayi, 83% C. elegans, 82% C. briggsae.

SEQ ID NO: 58 has the following amino acid identity to its nematode orthologs, 73% B. malayi, 62-67% C. elegans, 67% C. briggsae, 69% C. brenneri.

SEQ ID NO: 59 has the following amino acid identity to its nematode orthologs, 80% O. volvulus, 79% B. malayi, 72-77% C. elegans, 78% C. briggsae.

SEQ ID NO: 60 has the following amino acid identity to its nematode orthologs, 81% B. malayi, 84% C. elegans, 83% C. briggsae.

SEQ ID NO: 61 has the following amino acid identity to its nematode orthologs, 70% B. malayi, 69% C. elegans, 67% C. briggsae, 66% C. brenneri.

SEQ ID NO: 62 has the following amino acid identity to its nematode orthologs, 84% O. volvulus, 83% B. malayi, 71% C. elegans, 71% C. briggsae.

SEQ ID NO: 63 has the following amino acid identity to its nematode orthologs, 74% B. malayi, 80% C. elegans, 78% C. briggsae.

SEQ ID NO: 64 has the following amino acid identity to its nematode orthologs, 72% M. incognita, 72% G. pallida, 70% H. glycines, 70% R. reniformis, 65% C. elegans, 65% C. briggsae.

SEQ ID NO: 65 has the following amino acid identity to its nematode orthologs, 72% M. incognita, 72% G. pallida, 70% H. glycines, 70% R. reniformis, 65% C. elegans, 65% C. briggsae.

SEQ ID NO: 66 has the following amino acid identity to its nematode orthologs, 63% B. malayi, 64% C. elegans, 65% C. briggsae.

SEQ ID NO: 67 has the following amino acid identity to its nematode orthologs, 55% B. malayi, 50-52% C. elegans, 51% C. briggsae.

SEQ ID NO: 68 has the following amino acid identity to its nematode orthologs, 67% C. elegans, 64-67% C. briggsae.

SEQ ID NO: 69 has the following amino acid identity to its nematode orthologs, 55% B. malayi, 54% C. elegans, 51% C. briggsae.

SEQ ID NO: 70 has the following amino acid identity to its nematode orthologs, 94% B. malayi, 93% C. elegans, 92% C. briggsae.

SEQ ID NO: 71 has the following amino acid identity to its nematode orthologs, 50% B. malayi, 55% C. elegans, 57% C. briggsae.

SEQ ID NO: 72 has the following amino acid identity to its nematode orthologs, 51% B. malayi, 50% C. elegans, 55% C. briggsae.

SEQ ID NO: 73 has the following amino acid identity to its nematode orthologs, 79% H. glycines, 63% B. malayi, 64% C. elegans, 63% C. briggsae.

SEQ ID NO: 74 has the following amino acid identity to its nematode orthologs, 77% H. glycines, 50% B. malayi, 50% C. elegans, 48% C. briggsae.

SEQ ID NO: 75 has the following amino acid identity to its nematode orthologs, 55% B. malayi, 55% C. elegans, 55% C. briggsae.

SEQ ID NO: 76 has the following amino acid identity to its nematode orthologs, 85% B. malayi, 86% C. elegans, 86% C. briggsae.

SEQ ID NO: 77 has the following amino acid identity to its nematode orthologs, 81% B. malayi, 82% C. elegans, 82% C. briggsae.

SEQ ID NO: 78 has the following amino acid identity to its nematode orthologs, 82% B. malayi, 74% C. elegans, 76% C. briggsae.

SEQ ID NO: 79 has the following amino acid identity to its nematode orthologs, 62% B. malayi, 66% C. elegans, 66% C. briggsae.

SEQ ID NO: 80 has the following amino acid identity to its nematode orthologs, 85% B. malayi, 52% C. elegans, 54% C. briggsae.

SEQ ID NO: 81 has the following amino acid identity to its nematode orthologs, 52% B. malayi, 54% C. elegans, 54% C. briggsae.

SEQ ID NO: 82 has the following amino acid identity to its nematode orthologs, 42% B. malayi, 29% C. elegans, 32% C. briggsae.

SEQ ID NO: 83 has the following amino acid identity to its nematode orthologs, 87% B. malayi, 86% C. elegans, 86% C. briggsae.

SEQ ID NO: 84 has the following amino acid identity to its nematode orthologs, 72%, B. malayi, 68% C. elegans, 69% C. briggsae.

SEQ ID NO: 85 has the following amino acid identity to its nematode orthologs, 93% B. malayi, 93% C. elegans, 92% C. briggsae.

SEQ ID NO: 86 has the following amino acid identity to its nematode orthologs, 58% B. malayi, 54-56% C. elegans, 56% C. briggsae.

SEQ ID NO: 87 has the following amino acid identity to its nematode orthologs, 51% B. malayi, 51% C. elegans, 49% C. briggsae.

SEQ ID NO: 88 has the following amino acid identity to its nematode orthologs, 67% C. elegans, 66% C. briggsae.

SEQ ID NO: 89 has the following amino acid identity to its nematode orthologs, 64% B. malayi, 63% C. elegans, 63% C. briggsae.

SEQ ID NO: 90 has the following amino acid identity to its nematode orthologs, 82% H. glycines, 64% B. malayi, 63% C. elegans, 64% C. briggsae.

SEQ ID NO: 91 has the following amino acid identity to its nematode orthologs, 41% H. glycines, 42% B. malayi, 45% C. elegans, 45% C. briggsae.

SEQ ID NO: 92 has the following amino acid identity to its nematode orthologs, 55% B. malayi, 54% C. elegans, 56% C. briggsae.

SEQ ID NO: 93 has the following amino acid identity to its nematode orthologs, 74% B. malayi, 77% C. elegans, 77% C. briggsae.

SEQ ID NO: 94 has the following amino acid identity to its nematode orthologs, 83% B. malayi, 82% C. elegans, 81% C. briggsae.

SEQ ID NO: 95 has the following amino acid identity to its nematode orthologs, 79% B. malayi, 80% C. elegans, 79% C. briggsae.

SEQ ID NO: 96 has the following amino acid identity to its nematode orthologs, 62% B. malayi, 68% C. elegans, 69% C. briggsae.

SEQ ID NO: 97 has the following amino acid identity to its nematode orthologs, 88% B. malayi, 89% C. elegans, 89% C. briggsae.

SEQ ID NO: 98 has the following amino acid identity to its nematode orthologs, 61% B. malayi, 54% C. elegans, 52% C. briggsae.

SEQ ID NO: 99 has the following amino acid identity to its nematode orthologs, 48% B. malayi, 53% C. elegans, 54% C. briggsae.

SEQ ID NO: 100 has the following amino acid identity to its nematode orthologs, 30% B. malayi, 30% C. elegans, 29% C. briggsae.

SEQ ID NO: 101 has the following amino acid identity to its nematode orthologs, 88% B. malayi, 88% C. elegans, 88% C. briggsae.

SEQ ID NO: 102 has the following amino acid identity to its nematode orthologs, 61% B. malayi, 61% C. elegans, 59% C. briggsae.

Useful genes with particularly high nucleotide conservation to facilitates RNAi based broad spectrum control of Pratylenchus spp include kin-2, sec61, vab-10, cgh-1, vha-13 and rpb-2. These sequences nonetheless have sufficient nucleotide divergence from essential genes in non-target organisms such as humans, the host plant and beneficial insects to reduce the likelihood of toxicity to these other organisms if exposed to the nematode dsRNAs.

Other root lesion nematode genes contemplated for use in this invention include but are not limited to lesion genes comprising the sequences in seq id nos: 120 through 1064.

Example 4

DsRNA Sequences and Promoters for Gene Expression

FIG. 1 shows a schematic example of the typical hairy root expression construct used to select for combined chemical (basta) and fluorescence (DsRed) to produce hairy roots with uniform expression of a nematicidal gene of interest (GOI). The GOI could be a nematicidal nucleotide, protein or protein capable of producing a nematicidal agent (e.g., metabolite). In the current invention the GOI is typically a double stranded RNA (dsRNA) targeting an essential nematode gene. Kanamycin resistance is used for plasmid propagation within bacterial hosts. Basta (ammonium glufosinate:phosphinothricin) tolerance is conferred by the expression of the BAR gene (phosphinothricin acetyltransferase) under the control of the mannopine synthase promoter and terminator. The GOI can be driven by strong constitutive promoters derived from the cauliflower mosaic virus 35S promoter (35S) or figwort mosaic virus (FMV) or a variety of plant promoters such as the ubiquitin 3 promoter and terminators such as the E6, E9 or octopine synthase (OCS) terminator can be used. The red fluorescent protein DsRed can be driven by strong constitutive viral promoters or other promoters such as the actin 7 plant promoter with the use of terminators such as E6, E9 or OCS.

TABLE 3

Lesion dsRNA nucleotide sequences and promoter sequences

| | | |
|---|---|---|
| SEQ ID NO: 103 | Act7 intron | Intron from *A. thaliana* Act7 promoter |
| SEQ ID NO: 104 | FMV | Figwort mosaic virus promoter |
| SEQ ID NO: 105 | E35S | Enhanced cauliflower mosaic virus 35S promoter |
| SEQ ID NO: 106 | E35Sp | Enhanced cauliflower mosaic virus 35S promoter with the petunia translational leader |
| SEQ ID NO: 107 | 35SO | 35S promoter with the tobacco mosaic virus omega translational enhancer |
| SEQ ID NO: 108 | top1-2 dsRNA segment A | *P. scribneri* homolog of *C. elegans* M01E5.5b |
| SEQ ID NO: 109 | kin-2 dsRNA segment A | *P. scribneri* homolog of *C. elegans* R07E4.6 |
| SEQ ID NO: 110 | cgh-1 dsRNA segment A | *P. scribneri* homolog of *C. elegans* C07H6.5 |
| SEQ ID NO: 111 | Eng-1 dsRNA segment | *P. scribneri* homolog of *C. elegans* |
| SEQ ID NO: 112 | top1-2 dsRNA segment S | *P. scribneri* homolog of *C. elegans* M01E5.5b |
| SEQ ID NO: 113 | kin-2 dsRNA segment S | *P. scribneri* homolog of *C. elegans* R07E4.6 |
| SEQ ID NO: 114 | cgh-1 dsRNA segment S | *P. scribneri* homolog of *C. elegans* C07H6.5 |
| SEQ ID NO: 115 | kin-2 dsRNA segment O | *P. scribneri* homolog of *C. elegans* R07E4.6 |
| SEQ ID NO: 116 | Chimeric cgh-1 dsRNA | *P. scribneri/P. zeae/P. brachyurus/P. penetrans* chimera of *Pratylenchus* homolog of *C. elegans* C07H6.5 |
| SEQ ID NO: 117 | Chimeric kin-2-1 dsRNA | *P. scribneri/P. zeae/P. brachyurus/P. penetrans* chimera of *Pratylenchus* homolog of *C. elegans* R07E4.6 |
| SEQ ID NO: 118 | Chimeric top-1 dsRNA | *P. scribneri/P. zeae/P. brachyurus/P. penetrans* chimera of *Pratylenchus* homolog of *C. elegans* M01E5.5b |
| SEQ ID NO: 119 | Chimeric cgh-1/kin-2/top-1 dsRNA | *P. scribneri/P. zeae/P. brachyurus/P. penetrans* chimera of *Pratylenchus* homolog of *C. elegans* C07H6.5/R07E4.6/M01E5.5b |

A crop transformation base vector comprising selection expression cassettes and elements necessary for the maintenance of the plasmid in a bacteria cell is used to assemble DNA segments (promoters, leaders, introns, 3'UTR) that provide regulatory activity when operably linked to DNA segments that provide functionality in the present invention. The assembly of these DNA segments can be accomplished using methods known in the art of recombinant DNA technology. Examples of DNA sequences capable of coding for efficacious dsRNA molecules are SEQ ID NO: 108 through 119 in table 3.

Example 5

Tomato Hairy Root Efficacy Against *P. scribneri* Via Transgenic Rnai

Plates were inoculated with approximately 400 sterile mixed stage lesion nematodes and incubated at 30° C. At 56 days post infection plates roots were harvest and placed in glass bowls filled with sterilized water. After 9-10 days to allow the worms to exit the roots, the solution is poured off and the worms counted under a microscope. To determine weights, roots bowls were micro-waved to melt the agar and the roots are collected with sieve and root weights recorded.

Transgenic hairy root cultures were prepared expressing fragments of genes encoding, for instance, top1, kin-2, cgh1 and eng1 (e.g. SEQ ID NOs:108-113), and these roots were tested for lesion nematode resistance. Results are shown in Table 4, demonstrating efficacy in reducing lesion nematode reproduction.

TABLE 4

Efficacy of various dsRNA constructs

| Temp | P-GOI | DsRNA | P-DsRED | Test # | % Worm Reduction |
|---|---|---|---|---|---|
| 25° C. | E35Sp | Top1A | FMV | 1 | 42 |
| 25° C. | E35Sp | Kin2A | FMV | 1 | 36 |
| 30° C. | E35Sp | Top1A | FMV | 2 | 44 |
| 30° C. | E35p | Kin2A | FMV | 2 | 37 |
| 30° C. | FMV | Kin2A | E35S | 3 | 56 |
| 30° C. | E335p | Cgh1A | FMV | 4 | 42 |
| 30° C. | E35Sp | Eng1 | FMV | 4 | 5 |
| 30° C. | E35Sp | Top1A | FMV | 5 | 64% |
| 30° C. | E35Sp | GFP | FMV | 5 | −27% |
| 30° C. | E335p | Top1S | FMV | 6 | 26% |
| 30° C. | E35Sp | Kin2S | FMV | 6 | 33% |
| 30° C. | E35Sp | GFP | FMV | 6 | −38% |

Percent cyst reduction is calculated relative to a 35SO-dsred susceptible control. Promoters are the enhanced cauliflower mosaic virus 35S promoter with or without the petunia leader 35S (E35S or E35Sp) SEQ ID NO 105 and SEQ ID NO 106, respectively, the figwort mosaic virus (FMV) promoter SEQ ID NO: 104, and the cauliflower mosaic virus 35S promoter with the tobacco mosaic virus omega translational enhancer SEQ ID NO: 107.

The data in table 4 demonstrate that the promoter and target gene can influence the degree of efficacy against lesion nematodes. It is important to note that the nematode control seen is not a non-specific dsRNA effect as tomato hairy roots expressing GFP dsRNA are more susceptible to infection than the 35So-dsred wild type construct. Importantly, it is possible to achieve nematode control efficacy against lesion nematodes using a transgenic RNAi approach targeted against gene targets disclosed in this invention. Furthermore, this RNAi based nematode control effect is not weakened at higher temperatures as is the case for some types of genetic resistance to nematodes.

TABLE 5

Root protective effect of various dsRNA constructs

| P-GOI | DsRNA | P-DsRED | % Root weight gain |
|---|---|---|---|
| E35Sp | Top1A | FMV | 9% |
| E35Sp | Kin2A | FMV | 18% |
| FMV | Top1A | E35Sp | 26% |

TABLE 5-continued

Root protective effect of various dsRNA constructs

| P-GOI | DsRNA | P-DsRED | % Root weight gain |
|---|---|---|---|
| E335p | Top1S | FMV | 21% |
| E35sp | Cgh1S | FMV | 50% |
| E335p | Kin2O | FMV | 33% |
| E35Sp | GFP | FMV | 4% |

Percent cyst root weight gain is measured relative to the 35SO-dsred susceptible control. Promoters are the enhanced cauliflower mosaic virus 35S promoter with or without the petunia leader 35S (E35S or E35Sp) SEQ ID NO 105 and SEQ ID NO 106, respectively, the figwort mosaic virus (FMV) promoter SEQ ID NO: 104, and the cauliflower mosaic virus 35S promoter with the tobacco mosaic virus omega translational enhancer SEQ ID NO: 107.

All of the compositions and methods disclosed and claimed herein can be made and executed without undue experimentation in light of the present disclosure. While the compositions and methods of this invention have been described in terms of the foregoing illustrative embodiments, it will be apparent to those of skill in the art that variations, changes, modifications, and alterations may be applied to the composition, methods, and in the steps or in the sequence of steps of the methods described herein, without departing from the true concept, spirit, and scope of the invention. More specifically, it will be apparent that certain agents that are both chemically and physiologically related may be substituted for the agents described herein while the same or similar results would be achieved. All such similar substitutes and modifications apparent to those skilled in the art are deemed to be within the spirit, scope, and concept of the invention as defined by the appended claims.

Incorporation by Reference of Table Submitted on CD-ROM

Applicant hereby incorporates by references the sequences in the file entitled 12557-0047PO1_Sequences.txt (172 MB), created Dec. 20, 2009 and submitted by Express Mail (EV 828219291 US) on Dec. 30, 2009. The table contains *Pratylenchus scribneri* genomic sequence in the form of assembled contigs.

REFERENCES

The following references are incorporated herein by reference:

U.S. Pat. No. 4,536,475; U.S. Pat. No. 4,693,977; U.S. Pat. No. 4,886,937; U.S. Pat. No. 4,940,838; U.S. Pat. No. 4,959,317; U.S. Pat. No. 5,015,580; U.S. Pat. No. 5,107,065; U.S. Pat. No. 5,110,732; U.S. Pat. No. 5,231,020; U.S. Pat. No. 5,283,184; U.S. Pat. No. 5,302,523; U.S. Pat. No. 5,384,253; U.S. Pat. No. 5,464,763; U.S. Pat. No. 5,464,765; U.S. Pat. No. 5,501,967; U.S. Pat. No. 5,508,184; U.S. Pat. No. 5,527,695; U.S. Pat. No. 5,538,880; U.S. Pat. No. 5,459,252; U.S. Pat. No. 5,550,318; U.S. Pat. No. 5,563,055; U.S. Pat. No. 5,591,616; U.S. Pat. No. 5,593,874; U.S. Pat. No. 5,633,435; U.S. Pat. No. 5,693,512; U.S. Pat. No. 5,698,425; U.S. Pat. No. 5,712,135; U.S. Pat. No. 5,759,829; U.S. Pat. No. 5,780,708; U.S. Pat. No. 5,789,214; U.S. Pat. No. 5,804,693; U.S. Pat. No. 5,824,877; U.S. Pat. No. 5,837,848; U.S. Pat. No. 5,981,840; U.S. Pat. No. 6,118,047; U.S. Pat. No. 6,160,208; U.S. Pat. No. 6,384,301; U.S. Pat. No. 6,399,861; U.S. Pat. No. 6,403,865.

U.S. Pub. 2002/0048814; U.S. Pub. 2003/0018993; U.S. Pub. 2003/0175965; U.S. Pub. 2004/0029283; US Pub. 2006/0200878 A1.

Aird et al., *Plant Cell Tiss. Org. Cult.* 15: 47-57, 1988.
Altschul et al., *J. Mol. Biol.*, 215:403-410, 1990.
Atkinson et al., *J. Nematol.* 28:209-215, 1996.
Atkinson et al. WO03052110A2: Nucleic Acid Nematicides.
Ausubel et al., In: *Current Protocols in Molecular Biology*, John, Wiley & Sons, Inc, New York, 1998.
Barker et al., In: *Plant and Soil Nematodes: Societal Impact and Focus for the Future*, Comm. Natl. Needs Priorities Nematol., Cooperative State Research Service, US Dept. Arig. Soc. Nematologists, 1994.
Bevan et al., *Nature*, 304:184-187, 1983.
Broothaerts et al., *Nature*, 433:629-633, 2005.
Brutlag et al., *Computers and Chemistry*, 17:203-207, 1993.
David et al., *Biotechnology* 2:73-76, 1984.
De Meutter et al. *Mol Plant Path* 6:321-325, 2005.
Dellaporta et al., In: *Chromosome Structure and Function: Impact of New Concepts,* 18th Stadler Genetics Symposium, 11:263-282, 1988.
Elbashir et al., *Genes Dev.*, 5(2):188-200, 2001.
EP 0 120 516
EP 0 122 791
Fairbairn et al. 2007 Host-delivered RNAi: an effective strategy to silence genes in plant parasitic nematodes. *Planta* 226(6):1525-33.
Fire et al. 1998 Potent and specific genetic interference by double-stranded RNA in Caenorhabditis elegans. Nature. 391(6669):806-11.
Fire et al. U.S. Pat. No. 6,506,559: Genetic inhibition by double-stranded RNA.
Gamborg et al., *In Vitro* 12 473-478, 1976.
Gheysen and Fenoll, *Annu. Rev. Phytopathol.* 40:191-219, 2002.
Gruber et al., In: *Vectors for Plant Transformation*, Methods in Plant Molecular Biology and Biotechnology, Glick and Thompson (Eds.), CRC Press, Inc., Boca Raton, 89-119, 1993.
Hamilton and Baulcombe, *Science,* 286:950-952, 1999.
Hannon, *Nature,* 418:244-251, 2002
Haymes et al., In: *Nucleic acid hybridization, a practical approach,* IRL Press, Washington, D.C., 1985.
Herrera-Estrella et al., *Nature,* 303:209-213, 1983.
Hirel et al., *Plant Molecular Biology,* 20:207-218, 1992.
Horsch et al., *Science,* 227:1229, 1985.
Huang et al. 2006 Engineering broad root-knot resistance in transgenic plants by RNAi silencing of a conserved and essential root-knot nematode parasitism gene. Proc Natl Acad Sci USA. 103(39):14302-6.
Hussey et al. US20060080749A1: Nematode resistant transgenic plants.
Hussey et al. WO07087153A2: Cyst Nematode Resistant Transgenic Plants.
Ikatu et al., *Bio/Technol.,* 8:241-242, 1990.
Jefferson et al., *EMBO J.,* 6:3901-3907, 1987.
Juergensen et al. *Plant Physiol* 131:61-69, 2003.
Kaeppler et al., *Plant Cell Rep.,* 8:415-418, 1990.
Katz et al., *J. Gen Microbiol.,* 129:2703-2714, 1983.
Klee et al., *Bio/Technol.,* 3:637-642, 1985.
Matz et al., *Nat. Biotechnol.* 17:969-973, 1999.
Mazarei et al. *Plant Mol. Biol.* 53:513-530 2003.
Mazarei et al. *Mol Plant Path* 5:409-423, 2004.

McCarter et al., *Genome Biology,* 4:R26, 1-19, 2003.
McCarter, *Trends in Parasitology,* 20:462-468, 2004.
Michaeli et al. WO05019408A2: Plants resistant to cytoplasm-feeding parasites.
Miki et al., In: *Procedures for Introducing Foreign DNA into Plants,* Methods in Plant Molecular Biology and Biotechnology, Glick and Thompson (Eds.), CRC Press, Inc., Boca Raton, 67-88, 1993.
Moloney et al., *Plant Cell Reports,* 8:238, 1989.
Murashige and Skoog, *Physiol. Plant.* 15: 473-497, 1962.
Narayanan et al., *Crop Sci.* 39:1680-1686, 1999.
Niblett et al. WO06047495A2: Methods and materials for conferring resistance to pests and pathogens of plants.
Odell et al., *Nature,* 313:810-812, 1985.
Omirulleh et al., *Plant Mol. Biol.,* 21:415-428, 1993.
Opperman et al., *Science* 263:221-223, 1994.
Ow et al., *Science,* 234:856-859, 1986.
Padgette et al., *Crop Sci.,* 35:1451-1461, 1995.
Papp et al., *Nature,* 424:194-197, 2003.
PCT Appln. WO 97/32016; PCT Appln. WO 99/49029; PCT Appln. WO 99/53050; PCT Appln. WO94/01550; PCT Appln. WO98/05770
Piano et al., *Curr Biol.,* 12:1959-64, 2002.
Potrykus et al., *Mol. Gen. Genet.,* 199:183-188, 1985.
Ren et al. US20060037101A1: Compositions and Methods Using RNA Interference for Control of Nematodes.
Reynolds et al. *Nat. Biotechnol.* 22:326-330, 2004.
Sambrook et al., (ed.), *Molecular Cloning,* Cold Spring Harbor Laboratory Press, Cold Spring Harbor, N.Y., 1989.
Steeves et al. 2006 Transgenic soybeans expressing siRNAs specific to a major sperm protein gene suppress *Heterodera glycines* reproduction. Funct Plant Biol. 33(11): 991-999.
Sutcliffe, *Proc. Natl. Acad. Sci. USA,* 75:3737-3741, 1978.
Thurau et al. *Plant Mol Biol* 52:643-660, 2003.
Tobias et al. WO0137654A2: Methods of inhibiting plant parasitic nematodes and insect pests by expression of nematode and insect specific double-stranded RNA in plants.
Trick et al. US20040098761A1: Compositions and methods for controlling parasitic nematodes.
Vaghchhipawala et al. *Genome* 47:404-413, 2004.
Van De Craen et al. WO07104570A2: Nematode Control.
Van Heeke and Schuster, *J. Biol. Chem.,* 264:5503-5509, 1989.
White and Nester, *J Bacteriol.,* 141(3):1134-1141, 1988.
Winston et al., *Science,* 295:2456-2459, 2002.
Yadav et al. 2006 Host-generated double stranded RNA induces RNAi in plant-parasitic nematodes and protects the host from infection. Mol Biochem Parasitol. 148(2): 219-22.
Zukowski et al., *Proc. Natl. Acad. Sci. USA,* 80:1101-1105, 1983.

What is claimed is:

1. A transformation vector comprising a polynucleotide operably linked to a heterologous promoter functional in a plant cell, said polynucleotide comprising:
   (a) a first nucleotide sequence comprising at least 40 contiguous nucleotides of SEQ ID NO:1; and
   (b) a second nucleotide sequence comprising the reverse complement of the first nucleotide sequence.

2. A double stranded ribonucleic acid (dsRNA) molecule produced from expression of the transformation vector of claim 1, wherein uptake of said dsRNA molecule by a *Pratylenchus* nematode inhibits growth of said nematode.

3. The dsRNA molecule of claim 2, wherein said nematode is *Pratylenchus scribneri, Pratylenchus hexincisus, Pratylenchus brachyurus, Pratylenchus zeae, Pratylenchus penetrans, Pratylenchus neglectus* or *Pratylenchus crenatus.*

4. A cell transformed with the transformation vector of claim 1, wherein said cell comprises said polynucleotide.

5. The cell of claim 4, wherein said cell is a plant cell.

6. A plant transformed with the transformation vector of claim 1, wherein said plant comprises said polynucleotide.

7. The plant of claim 6, further defined as a crop selected from the group consisting of: corn, wheat, barley, rye, rice, potato, tomato, cucumber, pepper, clover, legume, soybean, pea, alfalfa, sugar cane, sugar beet, tobacco, carrot, cotton, canola, sunflower, safflower, sorghum, strawberry, banana, and ornamental.

8. A seed of the plant of claim 6, wherein said seed comprises said polynucleotide.

9. The plant of claim 6, wherein said polynucleotide is expressed in said plant as a dsRNA.

10. A commodity product produced from the plant of claim 6, comprising a detectable amount of said polynucleotide or a ribonucleotide expressed therefrom.

11. A method for controlling a *Pratylenchus* nematode population, said method comprising providing in a diet of said nematode an agent comprising a dsRNA molecule that functions upon being taken up by said nematode to inhibit growth of said nematode, wherein said dsRNA molecule is transcribed from a polynucleotide comprising (a) a first nucleotide sequence comprising at least 40 contiguous nucleotides of SEQ ID NO:1; and (b) a second nucleotide sequence comprising the reverse complement of the first nucleotide sequence.

12. The method of claim 11, wherein said nematode is *Pratylenchus scribneri, Pratylenchus hexincisus, Pratylenchus brachyurus, Pratylenchus zeae, Pratylenchus penetrans, Pratylenchus neglectus* or *Pratylenchus crenatus.*

13. A method for controlling a *Pratylenchus* nematode population, said method comprising providing in a diet of said nematode population a transformed plant cell expressing a polynucleotide comprising (a) a first nucleotide sequence comprising at least 40 contiguous nucleotides of SEQ ID

SEQUENCE LISTING (1064 sequences)

SEQ ID NO: 1 - DNA, 2650 bp, Pratylenchus scribneri
gggtttaattacccaagtttgagtgaaacgcacaaatacgcgttaaaattgatagattatatcaatcgctcttattgattatccaagacataaatcaattctraagaatctatggcagtgaaaatgggaatggatgctgtgatggaaaatggagatgaatccatgaatagcttgcaagggatgtccgaaaatcaggagccaattgtaaatggagtaaacgaattgaatggtgatggtgaacatcaaaatggtagcaacatgacaaatcacaccgcaatgtcaaatggggattcgaaccaaccgcaggatgatccggacaatattccatgggctcaacgtattcgagacaaacaacaagataaaggaaatgatgaagttccggatgacaatattccctgggcccaacgtatgcggaaaaacaaagctgataatggattagatcaatcatcgacagcgatggaagtggaaagcacggaaacaactcggtcaagcaaaggcacggaaacaacccgctcaagcaaaagaataagcaccactgctacaacgagttcaacttcacaaaagagtagaaaatcgaaagccgctgaaagcagcgatgaggaagaggaatacaagccagagaaaaagaaatcgaaaaaggaaacttcttccacaaaaaaggttaagaaggaagtgaaatacgaagaagaagaagaggaggatgaagcaccaacttcatcacataaaaagaagaaaaccaccaaagttgaagtcaaagaagagggcccagtaaagaagcgtaaaaaggtggtggaagaagaggaagtgtggaaatggtgggaagaagaacaagtgaccgaaaaggatttaaccgtgaaatggactaagctggagcacaaagggccaatgtttgcaccggaatatgttccaattccgaatactgttaaattcaaatatgatgggaagccaatacaactttcgaaagatgctgaggaggtggcatcattttatgcgaaaatgctcgaccatgattacacctcaaaaccagtgttcaataagaattttttcaaagattggcgaagggttatgaaaccagaagaacgtgaaaagataacggatttgaaaaaatgtgatttttcggaaatgcacgcccattttttgagtgaaaccgaaaaaagaaaagccagaaacaaagaagagaaaaaggctgaaaaggaagtgaaagatcaagaggcgaaagaatacggttatgcatcgctggacgggtataaacagaaaattggcaattttcgaattgaaccacccggtctttttcgcggtcgaggagaacaccccaaaatgggttgtttaaagaagagagtacgaccagaagatgtggtaatcaattgttcgccgggagggaaaataccaccgccaaaagggcataaatggaaggagattcgtcatgacaatacggttacttggctttgttcttggactgaaaatgttttgggcagcaacaaatacataatgctgaatccatcctcaaaattgaagggtcaaaaggattgggaaaagtttgagaaagcgagaaagttgaaaggcttggtcggtccaattcgagaccaatacatcatcgatttcaagagcaaggaaatgcggattcgacaacgtgccgtggccctctattttattgacaagctagcacttcgagctggcaatgaaaaggatacggaagaggcggcagacaccgttggttgctgttcccttcgctgtgagcatatcaaattgcacgatgaaatggatggccaaaagtatgttgtggaatttgattttctcggcaaggattccatccgctattacaatcgtgttcctgttgagaaggcggtgttcaagaatttgaaaatattcatggaaagcaaggaacccggggatgatttattcgaccgattggatacaagttcgctgaatatttatttgaaagaattgatggatggattgaccgcaaaagtttttcgtacctacaatgcatccatcacattgcaggaacaattggacaaactcacaaatcccgatgattctgtgcatgaaaagcttctttcatacaatcgcgcaaatcgccaagtggccattctttgtaaccatcaacgggcaattccaaaaacgcacgaaaagtcgatggaaaatcttgaaaataagatcaaagagaaaaagaaggaatacaaagaaataaaggctgaattgaagaagaagaaaagtgatgagaaattgcagaaaaagtacatgcgcgtcaaagagcaattggagaagctgaaaacccaacgcactgacaaagatgaaaataagcaaattgcccttggaacttccaaacttaattatttggatccgagaatcactgtggcctggtgcaagaaatatgaggtcccaattgagaaaatattttcaaaaacgcatcgtgacaaattccgctgggcaattgatatgacgaaggaggattttattttttgataatgaccaaatgatgtttaattttccaaataaaagcaccgacaatgaatgcactttttctagttcaattgtatttccctttttcatttgtgttaaattttaaaccttttaagcttatgattgtctttaaatgtacatatttaaatatacacacattctctcctcaaaaaaaaaaaaaaaaaaa

SEQ ID NO: 2 - DNA, 1302 bp, Pratylenchus scribneri
gggtttaattacccaagtttgagtgcagaagaacccttaaaaaggagcaaaacaaaacaaaagtgaggcgaaggcatcaacaaacccaattcgcatttacaaaactaaaaaaacgaattaaaaccaccttaatttgtgcgccaaaaaatgtcggcacaaagtgcggaagaggcccaacttgcctcatgccaggcatatgttcgccaacataacattcaacaattggtgaaggatgccatcgtttcgctgtgcatccacaaaccggacaaccctgttctgttcttgcgggaccatttcgatcgtattgccgccgaacagcaacgtcaacaattttcacaggaaactgtgcataatgtgccggacgaggatgacacgctggaggagccaccacgtttgccccaaggaaatcgcaggcggctgggcgtttcggcggaagtgccggacgaaaatgaggcggccaactatcaacgggttgtaattcccaaggatgaggacacccaaaaagcattgcgccaggcaatgtgcaaaaatgttctgtttgcccatttggatttggacgagcaaaaggcaatattcgatgcaatgttcccggtggaaaagccaaaaggcgagacaatcattgaacagggcgaagaaggcgacaatttctacgtgatcgacaatggcgaagtggacgtattcgtcaacggggaatttgtattgtccatcaaggagggcggctcattcggtgaattggccctgatctatgggacaccacgggcggccaccgtcgttgccaaatccgatttggtcaaactttgggccatcgatcggctcacctatcgggccatcctaatgggctcaacgatgcgaaagaggaaaatgtacgacgaatttttgagcaaagtttccattctctccgatttggacaaatgggaacgggcgaatgtggccgatgcactggaacaatgccaattccaggccggaacacacattgtggaacaaggtcaacccggcgatgaattcttcatcattgtggatggcgaggccgacgtccttcaaagacccaacgatgatgccccattcgaggtggtcggcaaattgggaccatccgaatattttggggaaattgccctcctattggatcgtccacgggctgccaccgttgttgccaaaactccattgaaatgcgtcaaattggatcgtgcccgattcgaacgtgtcatgggcccggtgcgcgaaatattgaagcgggatgttggccattacaattcatatgtgaaattgatgacttgaaaacaaatgcgaaaaaaaaaaaaaaaa

SEQ ID NO: 3 - DNA, 1777 bp, Pratylenchus scribneri
gggtttaattacccaagtttgagatataaaataaatcatctatattgcattattttcattggttcaaaactcaacaaatgtcaactgctgtttcgccatcaatttctgttgaagactggaaatcggaactgaaacttccccaaaaagacctccgatataagacagctgatgttactgcgaccaagggtatcgaattcgaagagtttggtttgtcacgcgatcttctaaaaggaatattcgaaaagggatgggaacatccaagtccaatacaagaagcatcgattgcaattgcactctcaggacaagatattctcgcacgagccaaaaatggaacgggtaaaactggcgcatattgcattccttgcattgagaaaattgatccaacgaaagaatacatccaagcaatgataattgttccaacccgcgaattggcattacaaacttctcaaatctgcgtggaattgagcaaacatctcaaaatcaagattatggttaccaccggtggcaccgacctccgtgatgatattttgcgtctcaatgggatcgtccatttggttgttgctactccgggtcgaattcttgatctcatggagaaaggtgttgccaatgtttctcaatgcaagaccatcgtgctcgatgaggccgacaaattgccttcgcaagatttccaaggagtcctggatcgtttggtcaatttcctgcctggtgatcgtcaaatcatgctctattcggcgactttcccaaagacggtggccctcttcatgagcaagcatatgcaaagaccatatgaaatcaatttgatggaggaattgactctgattggaatcactcaattctatgcctatgttcaagaaaagcagaaagtccattgtctgaacactctcttccgcaagctccaaatcaaccaatcaatcattttttgcaattccactcaacgtgttgaactgctcgccaaaaaaataaccgaacttggctattcttgctactacatccactcaaaaatggcccaacatcatcgcaacagggttttccatgaatttcgccagggccactgccgcaaccttgtttgctctgatcttctgactcgcggaatcgatatccaggctgtcaatgtggtcatcaatttcgactttcctcgcaactcggaaacttacctgcatagaattggccgttccggacgttttggtcatctcgggattgccatcaacctcatcacctatgacgaccgctacaatctgcgccgcatcgagaaggaattgaaaacgcacattgacccaatcccgaaggaggtcgatccaaaactttatgtggccgaacatcaaatggaccatgaggaattcgatcaagtggaggcggcggatatgaacaatcatcattcggcggcagaatcaaacagtgacgaacagcagcaaccgcaaatgatgagtggatgaattaattgtttggatgaaggatggatgaaacgacacaaacaaataaaaacatcaaatcgatcgtttcattccaatccaatattattgactttaaaatttgttaaaaggcccccattcctccctgatctcttcatcatcatcacaaatccaccatccatccacctttgctatcttccaatttgctaaatattgttttaattttcgcgtcctctcttctatctacatcatttattataaatgaccaatcgaccgaccacacaaatttatgttgcgaatttttgttcatcaccttttaatttgtttgaattgttaaaataaaacatacaaaaaaaaaaaaaaaaaaa

SEQ ID NO: 4 - DNA, 2557 bp, Pratylenchus brachyurus
gggtttaattacccaagtttgagataaattgatctacttatattaataaaaattgaatttcatagcatggcagtagaagctcagcaaagcatcatgtctctgcaaaatggaggaagcatctctatggattcttctattgttcaaaagaatgagccaattgaaaatggaataaattccacttcatcgagcggagaacatcaaaatggcaacacacctcacgaagatctggacaatactccatgggcgcaacgcatccgaaataaacgagagtccaaaactaccgatcaaagttatgaagaaaacgaagtttcggaaactcggattagcaaaaaaagcaagccgaattcaaacaaagtagaagttgagaagcatgtcaaaaagagaaaatcgaaagtcagtgaaagcagtgaagacgaatattcgcctgagaaaaagaaggcraaaagggatgctgctaaatcgtcaaagaagacaactaaaaaagaagtagtcaaacaggaggaagaaacgcctacttcgacgcacaagaaaaagaagaccaaaattgaaattgttgaagcatcttcgtcttcgggaagtccaacgaaaaagaggaaaaagatagaagaggaagaagaaatttggaaatggtgggaagaacaatctccggagcaatctgatgggaccgtgaaatggaagacgttagatcacaaaggacccctgtttgctccagaatatgtacctgtaccgaaatctgtccattttaaatacgatggaaagacaatggaattatcaaatcaaacagaggaagtcgcatctttttacgcgaaaatgcttgatcatgattacacttcaaaaccaatttttaacaagaactttttcaaagattggcgaaagatcatgaccccggccgagaaagaaaagattaccgatttaagaaagtgcgatttcagtgaaatgcacgcgtattttctcgccgagagtgaaaaacgcaaggcgcgaagcaaagaagaaaaaaaggcggaaaaggaaatgaaggagaaggaagcaaaggaatatggttttgcgctcttggatggatacaaacagaagattggaaactttcgaattgaaccaccaggactttttcggggtcgaggtgaacatcccaaaatgggctgtttaaaaagaaaagttcaaccggaggatattattatcaattgttcaaagggcgtgcatatacccccaccaaaagggcataaatggaaagaaattcgccaagataacatggttacttggctctgttcatggaccgagaatgtccttgggagcaataaatacattatgctcaatccatcttcaaagctgaaaggacaaaaagattgggaaaaatttgaaaaagcgcgcaagctgaaagcatatgttggtccaattcgtgaacaatatttaacggatttcaaaagcaaggaaatgcggattcgtcaacgggctgtggcactgtattttattgataaacttgcccttcgagcgggtaatgagaaggacaccgaagaagcagctgacacggttggttgttgttccctccgctgcgaacatatcaaattgcatgaggagatggacggacaaaaatatgttgttgagttcgacttcctcggcaaggactccatccgctattacaaccgtgtgccggtggagaagccagtgtttaagaatttaaaattgttcatggaaggcaaggagccaggcgacgatctttttgacagacttgatacaagttcactgaacacatatctgaaagaactaatggatgggcttacagccaaagtttttcgtacttacaatgcgtccataactttgcaagaacagcttgacaaactgacaaatgctgaggattccattcacgagaaactgctttcttacaatcgtgcgaatcgccaagttgccatcctttgtaaccatcagcgtgcaatcccaaaaagtcacgagaagtccatggaaacgttggaaaacaagataaaagaaaaaaagaaggaatacaaggaagtcaaggcagaattgaaagccaaaaagggcgatgagaagctggagaagaaataccatcgtgttaaagaacaactggagaaactgaagacgcaacgcactgacaaggacgagaacaagcaaatagccctcggcacctccaaactcaactatctcgatcctcggatttcggttgcctggtgtaagaaatatgatgttccgattgagaagatattttccaaaacgcaacgtgacaaattccgatgggcgattgacatggccaaagaagattttattttttgacatttcctactgccgggcgaacatcgggttgggaggtggcatgattgtgaagtccggacttttaatgcaatttcctggatcagcacattcacctttctttttagtttgatttttcaatgtgttattttttatattcccatcatcccccaaattttaatttttgtaatttttcaaagaaataccgcccataacaacatgaaaattgtccacaccttattttgtaaagttgtttaataaacttagtaaatggggaaaaaaaaaaaaaaaaaaaaaaaaa

SEQ ID NO: 5 - DNA, 1337 bp, Pratylenchus brachyurus
ccctttccagcacccaagaacaacaacaataataatattattattgcaccactcgctcccattggcgcagtttcagttcgcaaattgacgacaataataattgtgttgaacgccaacagcatcgaataatatatatatttcataattaaacagtatattccatcattcgccctgaacaaatgtcggccggaggacaaagcgcagaagaggcacaactcgcgtcatgccaggcctatgtgcgccaacacaacatccaacaattggtgaaggacgcgatcgtgtcgttgtgcattcacaaaccggacaaccccgtcctcttccttcgtgaccattttgatcgcctcgcagccgaacaacaacgccgacaattctcccaggagacagtccacaatgtcccggatgaggacgacacgctggaggagccgccccggcttcctcaaggtaatcgacgtcgtttgggggtttcggcggaagtgccggacgagaatgaggcggccaattaccagcgggtggtgatcccgaaggacgaggacacccagaaggcccttcggcaagcgatgtgcaaaaacgtgctgtttgcgcatttggacttggatgagcaaaaggccatttttgacgcgatgttcccggtggaaaagcagaagggggagacaatcatagaacagggcgaggaaggcgataatttctacgtgatcgacagcggcgaggttgatgtgttcgtgaatggggaatatgtgctgtccatcaaggagggcggctcattcggcgaattggccctgatttatggcacaccgcgcgccgcaacagtcgtggcaaagtccgagctggtcaagctgtgggccattgatcggctcacctatcgggccattctgatgggctccacaatgcgcaagaggaaaatgtacgatgaattcctgagcaaagtgtccattctgtcggacttggacaaatgggaacggcgacgcgctggaacatgccaattcgaggccggcacacacatcgtggaacaaggccaacccggcgatgaattcttcataattgtcgatggcgaggccgaggtgctacaaagaccgaatgacgaggccccgttcgaggtggtcggcaaactgggcccgtccgaatattttggcgaaattgcccttttgttggatcgaccccgtgcggccactgttgtcgccaaaactccgctgaaatgcgtcaaattggatcgcaatcgattcgagcgcgtcatgggcccggttcgtgaaattctgaagcgggatgtgagccattacaattcatatgtgaaattgatgacatgaacaggggagtgaggaagagaaaaaaaaaaaaaaaaa

SEQ ID NO: 6 - DNA, 1747 bp, Pratylenchus brachyurus
gggtttaattacccaagtttgagaacaatcatattaaaaattccaaaatgtctacagcaatttctccatcaatgtctgttgaagattggaaagcggagcttacactaccacagaaagatcttcgctacaaaacagctgacgtcactgcaactaaaggcttagaattcgaacagttcggtttatctcgtgatcttctgaaaggaattttcgaaaagggatgggaaggaccaagtcctatacaagaggcttctattgctatcgcactctcaggccaggacatacttgcgcgcgcaaagaatggcacgggtaaaactggcgcatattgcattccctgcattgagaagatcgattcatccaaggaacatatacaagcaatggtgattgtcccgaccagagaattggcgctccaaacttcgcaaatttgtgtggagctcagcaagcatctaaagatcaaggttatggttaccaccgggggcactgatctccgcgatgacatcttgcgcttgaacggtgtggtccatctggttgttgccactccaggacgaattcttgacctgatcgaaaagggagttgccaatgttgctcagtgcaaaaccgtcgttctcgatgaggcggataaacttctctcacaagattttcaaggagtactcgaccgtttggttaattttttgcccaatgatcgccaaatcatgctctactcggctacctttccgaagactgtggccacattcatgaacatgcacatgcagagaccgtatgaaatcaatctgatggaagagctcacactacttggcatcactcaattctatgcctatgtccaggagaagcaaaaggtccattgcctcaacacattattccgaaagcttcaaataaaccagtcaatcattttctgcaattccacacaacgcgtcgaacttttggcgaagaaaatcaccgaacttggctactcgtgctactacattcactccaaaatggcccaacatcatcgcaatcgggtattccacgaatttcgccagggccattgccggaatctagtctgctctgatttgttgactcgcggaatcgacattcaagccgtcaatgtggtcatcaacttcgacttcccgcgcaactccgaaacatatttgcacaggattggacgttctggacgattcgggcaccttggaattgccatcaacctcatcacgtacgacgacagatacaacttgcgccgcattgagaaggaattgaagacacacattgacccaattccgaaggaagtcgatccaaagttgtacgtcgcagaacatcaaatggaccttgaggcctttgatcatccggaaatgaacaatcatcaccattcggacgagtcggtcaatgacgggcatcagggaagcggttgaatggattgacggaggatgacaacaggagaaaggcttctcgtcaatgttttggatttgaggaagtattatggcggatggcgcgcgcccgatctcctatcatcatcatctatcatacgttatcttattatgttccaaatttgttaagaatatatatgtaatagcttctttatctccctccgcacccccttcccccacattttgtgaccacaccaccaatccatctgccctcgtcatccatcaatgtttttaaatttgttattccatcaaaaagtggatttgttatttaaatgcgaaatgtggttttggttgtttttcccattgacagacagtaaatgattaaatcaccaaaaaaaaaaaaaaaaaaa

SEQ ID NO: 7 - DNA, 2680 bp, Pratylenchus zeae
gggtttaattacccaagtttgagagatttactaatctattgattgtttttattccttcttctgtcctgatccactgactatggaaatggaaactgattccgtgaacatgaatgataatctacagaatggctgtcatgatcatggtggagaagatctaaacacaagcggtgaaatctcttcattaggacaatccctcgaaaatggggttgattcggggcaatcaaatggtggacatcaaaatggggacaattcagctgaaaaagagaccccatcaacagatgaagcaaaggacaaagaagacttggacaatataccttggtcgcagcgtataagaaataacaagaaaaaatccgaaaatggagtcgcccatctaaataataccatttctgtgtcggaagagactattgagacaagaacaccaaaaagaacaaaaacaggcacagctgtacaagtcgaaaagcgtcgcaaaaccaggaaggaaagtgaaagcagtgtggaagagtacaaaccggagaagaaaaaatcaaaaggttctacaaaagcctcatcgtcatcagtcgaaaccgtcaagacagaaattaaggaggaagagaagagtcctgacggtgttactcacaaaaagaagaagaccatcaaaatagaagtcaaagatgagccatcttcatctggaagtccaacaaagaaacgaaagaaggtcgaagaggaagaagaagtctggaaatggtgggaagagcaagaacaggcccctgaaaagtcggatggcactattaagtggagcactctagagcataaagggccgatgtttgcccccgaatatgttccaatcccaaagactgtcaagttcaaatacgatgggaagcccatggagctttcaactgctgctgaagaagttgcatcattttatgcaaagatgcttgaacatgactacacttcaaagccgatcttcaacaagaactttttcaaggattggcggaaagttatgacccattcagaaaaggagaagatcacagacttgaaaaagtgtgattttactgaattacatgcccattttgtggcggaaagtgaaaaaaggaaggcaagaagcaaagaagagaaaaaagaggaaaaggaggcaaaagacaaggaggcaaaggagtatggatttgcaactttggatgggtacaaacagaaaataggcaattttcgaattgaaccacctggtcttttccgtggtcgaggcgaacatccaaaaatgggatgtttgaaaaagagaatccagccggaggacgtggtcattaattgttcaaagggagttcatataccaccgccaaaaggtcacaaatggaaagaaatccgtcatgacaataccgtcacatggctttgttcttggactgaaaatgttttgggcagcaacaaatgcatcatgttgaatccatcttcaaagcttaaaggacaaaaagattgggaaaaatttgagaaagcgcgcaagttaaaaggtttcgttggtcccattcgtgaccaataccttacggacttcaagagcaaggagatgcgaatccgccaacgagccgtagcactttatttcatcgacaaacttgccctcagagctggcaatgagaaggatactgaagaagctgctgatacggttggttgttgttctcttcgctgcgaacatatcaaactgcacgatgagatggatgaccagaaatatgtggtbgaattcgatttccttggaaaggattccattcgttactacaatcgtgtgcccgttgaaaaggctgtgtacaaaaatttgaagatctttatggaaggcaaggaacccagcgatgacctttttgatcgacttgatacaagctcattgaatgcttatctgaaggaattgatggaaggattgacagcaaaagtgttccgcacatacaacgcatcaatcacattgcaggaacaactggataaactaaccaatcctgatgacccaattcacgaaaagttgctctcctacaatcgcgcaaatcgacaagttgccattctctgtaaccatcaacgtgctgtgccaaaaagtcatgacaaagccatggagaatttggagaacaaaatcaaggacaagaaagctgaatacaaaaagacaaaggcagaactgaagaagaacaaaagcgacgagaagttgcagaaaaaatatctgcgtgtgaaagagcaacttgacaaattgaagacacagcgcactgacaaggatgagaacaaacaaattgctctgggcacttcaaaattgaattatttggatccgagaatttccgttgcttggtgcaagaaatatgaagtgcccgtggagaagattttttcaaagacgcaacgtgacaaattccgctgggcgatagacatggccagagaggatttcatattttgatgctgaccaatgaacacagtcgatcgcatcaagcgcgggttggggagttatatatatcaagtcttgattcaaatgtttcataaaatcgatcagcaccatgcaccttctcttctagttcaattcctacaaagaacacatgtgttaccccctcctatcgttttaatgctttttacgtacatatacttacaatgctcccacttgttttgtaaatctgttctctaataaacttttcaagggcatacactgtacaatatttttattaatcaattaaaattaaattaaaaaaaaaaaaaaaaaaaa

SEQ ID NO: 8 - DNA, 1738 bp, Pratylenchus zeae
gggtttaattacccaagtttgagcagtgttcagtgcatcagaaccgaaccgaccacccgacactgacacaacaatcttgatattgtgggcggccaaggaacgcgcaaaattttgctgcgcaagtagacaaccgaccaagcaatcagtcagtcgtttcattttgtggtgcaaccgtgcagccagtgtggaaaacaacaaacacaactaactaatccaaatattttccatctaattaactgaaaatgtcacaaagtgcggaggaggcgcaactcgcatcttgccaggcctacgttcgacagcacaacatccagcagctggtcaaggatgccatcgtgtcgctgtgtatccacaagccggacaatccggtgctctttctgcgcgaccactttgaccgtcttgccgctgaacagcaacgccagcaattctcccaggagaccgtccacaacgttcccgatgaggacgacaccctggaagagccgccacggctgccccaaggcaaccgccgtcggctgggcggttccgccgaggtgccggacgagaatgaggcggccaactaccagcgggtggtgatccccaaggacgaggacacccagaaggcgttgcgccaggcaatgtgcaagaatgtgctctttgcgcacttggatttggacgagcagaaggcgatcttcgatgcgatgttcccggtggagaaacaccagggcgagacaatcattgaacagggcgaagaaggcgacaacttctacgtgatcgacagcggcgaagttgacgtgttcgtgaatggcgagtacgtgctgtccatcaaggagggcggctcctttggcgagttggcgctcatctatggcacgccccgtgccgcaactgtggtggccaagacggatttggtcaaactgtgggccattgaccgcctcacctaccgggccatcctgatgggctccacaatgcgcaagcggaagatgtacgacgagttcctttccaaagtgtccatcctggccgaccttgacaagtgggaacgggccaatgttgccgacgcgctggagcagtgccaattcgagcagggaacacatgtggtggagcaaggccaacccggcgatgaattcttcatcatcgttgacggtgaagccgatgttctgcagagacctaacgaggaggcagcctttgaagtggttggcaacttggggccatctgactactttggcgaaatcgcccttctcctggaccgtccccgtgcggccactgttgttgccaaaacgccgttgaagtgcgtcaagttggaccgaaacagattcgagcgtgtcatgggcccagtgcgcgagatcctcaagcgtgacgtgagccactacaacagctatgtgaagttgatgacctgagggctcttcaatgcgaagaatgcacagaaaataagaggaggagccaaaatgtggagcagtaaagaagattttgactgttctgcgctctgaccaacttttaatatttttaattttcaaatattttattgccccaaagctttagcccgcgcccttctccccaccaatttccaccatcaaattgtgtattcttcaagccaatttagtctcttcctttgtcgtcctttcacattcaccacagacaaaacaaaacaattttgctatgtattcaatgttcatcctattcatgtcatccccgtatccccgaacgaacatgaaaatttggttggtaaattggcgtgacccgcgcattttatccaaaaaaaaaaaaaaaa

SEQ ID NO: 9 - DNA, 1645 bp, Pratylenchus zeae
gggtttaattacccaagtttgagatccgatttaattaaatttaattaaagcaaaatcacaatctgaatctgaacaacaatgtcaactgctgtgtctccgtcattgtctatggagaattggaaggcggacctgaatcttcccacgaaagaccttcgctacaaaacagccgatgtgactgcaaccaagggaatcgaattcgaagagtttggcctttcgcgcgatcttctgaagggaattttcgagaagggatgggaacgccccagtcccatacaggaagcgtcgattggcattgcgctatcaggacaagacattttggcgcgagcaaagaacgggaccggcaaaacgggtgcctactgcattccgtgcatagaaaagattgatacgtccaaggagaacgtccaagcaatgatcattgtgccgactcgtgagcttgcgctccaaacttcgcaaatctgtgtggaactcagcaaacacctcaacattaaggtcatggtcactacgggtggtacggatttgcgcgacgacattctgcgcctcaacggcgttgtccacttggtggtggccactccgggccgaattctggatttgatggagaagggagtggccaacgtgtcccaatgcaaaaccgtcgtactcgacgaggcggacaaactgctctcgcaagacttccaaggtgttctggaccgtctggtgcattttctgccgcacgaccgccaaatcatgctctactcggccacattcccgcgcacggtggccacattcatgaacaagcacatgcagcgaccctacgagataaacctgatggaggagctcactctgttgggcatcacccagttctacgcgtacgtgcaggagaagcagaaagtgcattgcttgaacacactcttccgcaagctgcaaatcaaccagtccatcatcttctgcaattccacccagcgtgttgagctgcttgcgaagaaaatcaccgaactcggctactcttgctactacatccactccaagatggcccagcaccatcggaaccgggtgttccacgaatttcgccaaggccattgccgcaacctggtgtgctctgatctgttcacgcgcggcatcgacatccaggccgtcaacgtggtcatcaacttcgactttccgcgcaactccgagacgtacttgcacagaattggacgctctggacgttttggccacctcggcattgccatcaacctcatcacctacgacgaccgctacaacttgcgacgcatcgagaaggagctgaaaacgcacattgagcccatcccgaaggaggtcgatcccaagctgtatgtggccgaacatcagctggaccacgaggtgttcgaccatgatgagcaacaaagcagcatgatgaacaacaaccaccacatccactcgaatgcgacggacagtgaggagcagaacctgagcggatgaagaggaggagggaacgggaaagcagccagtgcctcgccagcaacaacattgacttgaataatcgaatgcttgcacaacatgttattaccaaaggtttgatctctccccatccccagccaatcctcctctgccaccaccagatccccaatttgctacgttttaaatttgttaaagtaaaatccacctattttaaaaaaaaaaaaaaaaaaaa

SEQ ID NO: 10 - DNA, 602 bp, Pratylenchus penetrans
gatcaagtcggttgttgttcacttcggtgtgagcatattaaactacatgatgaaatggacggacaaaaatacgttgtcgaatttgactttctcggtaaagactcaatccgctattacaatcgtgtaccagtggagaaagcagtgttcaaaaatttgaaaatatttgttgaaggcaaagaaccgggcgatgatctctttgatagccttgatacaagttccttgaatgtatatttgaaagaactaatggatgggctgacagcaaaggtgttccgtacttacaatgcatccattactttgcaagaacaattggatcaattgacaaatgccaatgattcgattcatgaaaaacttctctcgtataatcgcgcaaatcgtcaagtcgccatcctttgtaaccatcagcgagcaataccgaagagccatgagaaatcaatggagactctagaaaataagataaaagataagaagaaggaatataaggaaatcaaggcagaattgaaggggaaaaagggtgacgagaagctacaaaaaaaatatgtgcgcgtgaaagaacaattagagaagctaaaaacacaacgcaccgacaaggatgagaataagca

SEQ ID NO: 11 - DNA, 1203 bp, Pratylenchus penetrans
gggtttaattacccaagtttgagtcaaaatcatccgccaattcttttccatcctccttccattcagccagcccaaaaatcgacaacaacgaatcagccaatccaaaaatttccgcccgcctccacttcccaaaacaaatcggcaatccattttgtccgctcgccatccatcccaacagcctattcaaacataatctccgtcccctccccattggccaatttgtcatcctcgcaaattgggaaaattgccttcgccttcttacggactggtcatttggccacatttgcttctcagtcaactctccaccactttccaatatcaataattatcttctcccttgtattctctgccatccaaatttgccataattcccggctccccaacatccatgacattctcctgtttgtgaacatttaaaagaatgggccaaagtttacgccgattacggcggaatcagcaggcaatcacggtggagggtggccaaaagagggaggaaggaggggaacaacagcagaaaagcacccctgctgctgcaccacaaggaggttcggctggaaacagtggaggcgatggaagtccacggaaagccctagccgagaagggaaatcaacaaaaaaaggaaacggcccacaatgtgccggacgaggatgacactttggaggagccgccccgcttgccccaaggcaatcgccgccgtttgggcgtctctgccgaagtgccggacgagaatgaggcggcaaactatcagcgggtcgtaatcccaaaggatgagaacacccaaaaggcccttcggcaggcaatgtgcaaaaatgtcctttttgcccatttggattttgaggaacagaaggccatctttgatgctatgttcccgttggagaaatcgaagggcgaaacaatcattgaacagggcgaagaaggcgacaatttctacgtgatcgacaatggggaagtggatgtttttgtgaatggggaatatgttctgtccatcaaggagggcggctcctttggtgaattggcactcatttatggcactccccgggctgccaccgttgtggccaagtccgatttggtcaaactttgggccattgatcggctcacctatcgggcaattctgatgggttcaacaatgcgaaagaggaaaatgtacgacgaattcctgagcaaagtgtccatcctttcggatttggacaaatgggaacgggc

SEQ ID NO: 12 - DNA, 584 bp, Pratylenchus penetrans
gggtttaattacccaagtttgagatcattaacaaacagggacaacgttcaaaaaattatttacttatgtccacagctatttctccatctatgtctgtggaagattggaaggcggaactcaaacttccgcagaaggatcttcgctttaaaacagctgacgtgactgcaactaaaggattagagtttgaggaatttggtttaacccgtgatcttctgaaaggaatttttgaaaaaggttgggagcgaccaagtcctatacaagaagcttctatcgcaatagcactctcaggacaagatatacttgcacgagcaaagaatggaacgggtaaaactggcgcatactgcattccttgcatcgaaaagattgattcatccaaagaatacatccaggctatgatcattgtcccaaccagagaattagctcttcaaacgtcgcaaatatgtgttgaactcagcaaacacctcaaaattaagatcatggtaaccacaggaggaactgatttacgtgatgacattctacgcttgaatggtattgtgcacttggtagtagcaacacctggtcgggttctagatttcatggaaaag

SEQ ID NO: 13 - DNA, 1146 bp, Pratylenchus scribneri
atgtttcgattgcctctggcattgtcacttattttgctcctttgcgtaacacttgtctccaattcaaaatggcgaattcaacgcgatttggaggacatttcatcgacttcggatgaaacggcagacattcaggatattcgcattgagccttcatcaccagtccgaaatggcctaaatcatcttcgccaattgatcgaacgaggttttgctgattggcgaaacttcaaagaaagacacggaaaatcgtatccaaaccaggacgaagacaatgaacgaatgttggcctatttaagtgccaaacaatttattgaaaagcataatcaggcatatgaccaaggaaaaatcacattcaaagttggggaaaattccattgccgatttgcctttcaatgaatatcgaaaattgaatggcttcaagcgggcaatgggcgatagaatgcgacggtggaattcaagcagttttatgccacctttgaatttggaagatattccggaatcggtggattggcgggacaaaggattggtgaccgccgtcaaaaatcaaggaatgtgtggttcgtgctgggcatttagtgcgacaggagcattggaaggccaacatgcccgaaaattgggtcaattggtttcattatcggagcaaaatttggtggattgttccaagaaatatggaaatatgggatgcaatggaggattgatggacaatgcttttcaatatgtcaaagacaataatggaattgacaccgaaaatagttatccgtataaagcaaagactggccgaaaatgtctcttcaaagcgggggatgttggagcaactgacaccggatttgtggatttgcctgaaggcaatgaagaaaagttgaaaattgccgttgccacacaaggaccagtttcagtggcaattgatgccggccaccgtagcttccaactttacactcatggggtttacaatgagaaagaatgcgacccagaaagtttagatcatggtgttttggtggttggttacggtacggatccggaacaaggcgattattggattgtgaagaatagttggggcgagaaatggggcgaagaaggttacattcgaatggcacgcaacaaaaacaaccaatgcggaattgcttcaaaggcttcatatcctcttgtttga

SEQ ID NO: 14 - DNA, 1146 bp, Pratylenchus scribneri
atgtttcgattgcctctggcattatcaattattttgctcctttgcgtaacacttgtctccaattcaaaatggcggattcaacgcgatttggaggacatttcatcgacttcggatgaaacggccgacattcaggatattcgcattgagccttcatcgccggtccgaaatggcctaaatcatctgcgccagttgatcgaacgcggttttgctgattggcgaaacttcaaagaaagacacggaaaatcgtatccaaaccaggatgaggacaatgaacgaatgttggcctatttaagtgccaaacaatttattgaaaagcacaatcaagcatatgaacaaggcaaaatcaccttcaaagttggggaaaattccattgccgatttgcctttcaatgaatatcgaaaattgaatggtttcaaacgggcaatgggcgatggaatgcgacggtggaattcgagcagttttatgccacctttgaatttggaagacattcctgaatcggtggattggcgtgacaaaggattggtgaccgccgtcaaaaatcaaggaatgtgcggttcctgctgggcatttagtgcgactggtgctttggaaggccaacatgcccgaaaattgggtcaattggtttcattatcggagcaaaatttggtggattgttccaaaaaatatggaaatatgggatgcaatggaggattgatggacaatgcttttcaatatgtcaaagacaataatggaatcgacaccgaaaatagttatccgtataaagcaaagactggtcgaaaatgtctcttcaaagcgggggatgttggagcaactgacaccggatttgtggatttgcctgaaggcaatgaagaaaagctgaaaattgccgttgccacacaagggccagtttcagtggcaattgatgctggccaccgtagcttccaactttacactcatggagtttacaatgagaaagaatgcgatccggaaagcttagatcatggtgttttggtggtcggttacggtacggatccggaacaaggcgactattggattgtgaagaatagttggggcgagaaatggggcgaagaaggttacattcgaatggcacgcaacaaaaacaaccaatgcggaattgcttcaaaggcttcatatcctcttgtttga

SEQ ID NO: 15 - DNA, 1523 bp, Pratylenchus scribneri
gggtttaattacccaagtttgagaattttcttacttaaaatggaaaaagaagatactaaaaacattgaaaaggttgaaaattgcgccgacacttttgagaaattgaaaataaacaccgaattgtgcagcgcatgtgaacgcattggttggaaaaaaccgatgccaattcagcaaaagatcattccattagcacttgctggtaaagatgtgattggtttggccgaaactggttctggcaaaactggtgctttcgctttgcccatcctccaagcattgatggaaaatcctcaacgactttttgcggttgtgctggccccaacccgagaattggccttccaaatttctgaacaatttgaagcacttggcgccacaattggtctccaagtttgtacaattgttggcggcattgatatgtccactcaaacattgtcactttccaaacggcctcatatcattgttgcaacgcctggtcgtcttgtcgatcatctggaaaacaccaaaggcttcgatcttcgaccggtcaaatatttggtcatggacgaggccgaccgaattttgaacatggattttgaagtggaattggacaaaattttgaaagttattccaaaaaccaggaaaacttatctgttttcggcgacaatgactcaaaaggtttcaaaactggaaagagctcatttgaagaacccggcccgtgttgagctctcatcaaaatatcaaaccgtgagcacccttatccaaaacatgctgttcatcccattcaaatataaggaagcctatttggtctatgtgctcaatgagaaggcggggaacaccgcaatagttttcgttgggacttgtgccagcgccgtcaaattggctttgatgcttcgacatttgggttttggtgccatcgcccttcatggacaaatgtcacaacctaaacggctgggcgcactgaacaaattcaaaaagaaggatcgacccattttggtctgcacggatgtcgcttccagaggtaattttttgttgttatttcgattttaaatgttaaatttaaaaggattggacattccgcatgtggacatggtcctgaattatgatgttccggctcattccaaggattacgtgcatcgtgtcggacgaacggctagggctggaaagtctggcgtagcactgaccatgattacccaatacgacgtggaaatctaccaaaaagttgaaaattcccttggcaagaaattggacccaatggaagtgaaccatgaggaggtgatggaattggtggaacgcgtttcggaggcaggtcgaattgcagcaaatcgatacaaagaaatggtggatggtgcaaagggcggtggccgtagaaggaaattattgggtgaaaatgaggatgaagacttggaaccggccagaaagcaccaaaaagccagcttgcaacagcacaataaaatgaggcgaaagaaataaattcattgatttatttttgttatttttcattgttttttgaataaatttgttcccttaaaaaaaaaaaaaaaaaaaaa

SEQ ID NO: 16 - DNA, 3513 bp, Pratylenchus scribneri
gggtttaattacccaagtttgaggtttatgcagaccataaatattggcgagccagtttacaaaaaaccaaaaatgcatgggaatggacaagtttgttccccaaattcaattgcaccaacgaaggaaaatgggcaagaaaatgatcaacaaaaaacccaacaacagcaaaaggagaattccatggatagcggcggagtggataccaatctttattcgagacaaatctatgctctgggtgagtcagcaatgtcccatcttcgcaaagcatcagttctggtcagcggaattggctcagttggattggaaatttccaaaaatctcattcttggaggtgttcacaatgttactttgcacgaccaaaagcagctgactttcaacgatttgtccgcacatttctattcttcagaggctaacattggacaaaatcgtgttcaaacatgtttcgaaaagttagctgaactgaatgacacagtcaattgctcaatttccaccgaaccgctaattcaggatttcatcagtcaattcgatcttattgtcatcaccgatacttcatgggaacagcaaatcactttgaacaattgggcacgaaagaatggcaagaccaaattcattgcggccgatgcccgtggacttttctcctatgcttttgtggatttgggcgaccaatttcaagtgaatgattcggatggcgaagcttgcaaagagattctacttgaacacatcaacacggagaccggcgaaatccacacattggagggaacattccatggactggaggatggcgatcaaattgttttggaggactttgagcaagcgcaactgaacaatctgccgccaatgacaattaaaaccgcaaataagggaaatattctgaatgtggaaaagcgctggcgccatttgccaatctatcccggcacaaatcactcgcgacgcgcaaacagtgaaagcgcccaaatgatcacattccaatcatggagctgcatgatgagccggattctcatctggactttgccaaatcgaccaactccacaattgcattcactctggcaggcttgtatcgcttgggaaaaaggacgctctccacaacctcgttcaaaggaggatgcagaacttttgaagaaagaattgctggaaggttcgccggaaattcccgaggaattgctcaacaatttttcttatcaagcaaccggaaatctgcagccaattgcctcattcattggtggttttgttgtgcaggaggcgatgaaggcggtcacccatcacacaatgccattgcgccaatttctttacaccgattcatgcgaggcacttcccggggaatattccacctttgattcggccaaattgacaatggaagattgtgcaccgcgaaattgtcgctatgatggacaggcagcagtttttggttgggcattccaggaggcattggaacgccagcattggttcattgttggtgccggcgcaattggctgtgaattgctgaagaattttgcgatgatgggagcggcctgcgacaagaatggtgccggacaattgaccataaccgatccggacacaattgaagtcagcaatttgaataggcaattcttattccgtcgaccggatgttgggaaaaagaagtcagaagttgcggccaatgcagtgcaaaaattcaatcctgctctgaatattcgtccattggctgaaattgtggccgaaagcactgaacaaattttccatgatgattttttccatcaactcaatggaatttgcaatgcattggacaatgtggaagcacgccgttatgtggatcgtcgatgtgtttattatcaactgccattgcttgagtccggcacaatgggaacaaaaggaaacacccaagtggtttatccgcatctgaccgaatcttattcgtccacttctggtccaccggagaaggaaacgccggtttgcacacttcgcaattttccataccaaatccaacacacaattcaatggggaaaagcgaaattcgttgaccatttcacatcggttgccgaaaccgtcaatcaatatttggacgatgtggccggttgtctgcgacgaatgaaagagcaaatgaaccaaggacaacagctggaattgttgcgaactctcaaccgtgcattgattgaagaatgcccaaaaacccgtgaggattgcgtctattgggcccgcgacctgttcgacacactctatcgaaatgacattcagcaattgctgcacaattttccaccggatcaagtcacttcacatggacaaaaattttggtctggcacaaaacggtgcccacatccattgacattcaatgtgcttgataaagatcacttcgaattcgtgtacaccgcctcaattcttcgtgcccaactttacaatttggaaccaattttgaatcgactggatgtcgcaaatttggctcaagcttaccaatctaagccattcgtcccgagagatggagtccgaattgcggtgaccgatgcggaggccacaaatgaagcagagaatggtgccggtgcmgatggagaagatgatgttgaacgcattttggatgttctgaatgtgaatttggcacgattgaatttgggcaacattcaacgctttacgccaattgactttgagaaggacgatgacacaaaccatcacgtggatttcattacggctgcatccaatttgcgggcggacaattacaatattgaaaaggcagatcgaatgaagacaaaacaaatcgccggtcgaatcatcccagcattggccaccacaaccgcaattgtctccggattggtctgcattgaattctacaaaacmattgaggcaaagggcatcgcaaaaacgccaattgaacgattcaagaatgcattcctcaatttggccactccattcatcgctttcagtgaaccagggaaggcagcaaagaagaagtatcgtgacattgaattcaccctttgggattgtttggaagtgaatggcccaatgacacttggacaattgattgaatggattgaggctcaaactggattgaccgtgtcgatgatgtcttcgggtgtttctcttctctatgcattcttcactccaccggcaagggtcaaggagagaaaagaaaaagaccttctgaaagtggtggaagaggtgtccaaaaatccggtcccggaatttcgtcgatcccttgttttcgaagtgatcacccaaaatgatcaggacgaagatgttgagatcccttatatcaaatataattttcgccgttagaagaagcaaatgacaaagatgaagaagataatttggatattgaaaggaatttttgatgataatttaatttgactttcccccaattttccaccttatctattatttaaattgttttttttttttttgctttttttccaaataattggtggacttctcctttaaaattgcttgacctaaaaattacttcttcagaccttcatcaatctacatatttgtttgtttttttttttggtttaaataaacgagtaaatgcgcaaaaaaaaaaaaaaaaaa

SEQ ID NO: 17 - DNA, 1560 bp, Pratylenchus scribneri
gggtttaattacccaagtttgagataaccaaaatatggtaatggaacaaaatgggaatttgggtgaacaagttgaggaaattgctgccggacaccacatgaccccggtggatatgaccaccgcaacttcaaaattacaattagaggccgccgaaattcgaagcccagtcaacaaaccaaattggacttcctatttacgctcccagctggttccgcaaaatgaatacaatttcattgtggcattggaagcagccaaaaataaagctgaacgcgacgaagtactcaatcgggacccaaacaattcggcaaaatgcataattaatttaatcattgaagtggccaaagaccagctaattcgatatgttttgactgtttttgatgatttattgcaagaagacaaggccagggttgaaatattccatgaatattcaagacgacaaaaacgcacaatttggtcctggtttcaaggaattctgacccgaaatgatggtttcattgtaaatcagatgtctgcaatttttgccaaacttgcatgttttggcactgtccatatggaaggacaggaattgaatgcttattacaattttatcaaaggagaattacgcaattcgaataatgaatatatcaatacatctgttcgatgccttcaaatgatgcttcgaattgaggaatatcgccacgcatttgttgccaccgatggtgtgcccagcataatgtcagctttggatggacgggcaaatttccaattacaatatcaactaatattctgcctttggtgtttatcatttaatagtaacattgcacgatatattcaaagttcgggcgttattcaagcattgggcgatattctttccgaatgttcaaaggaaaaagtcgttcgaataattttgcatacattccgaaatttactcgagaaaattgacaatcgagatttagtccgtgaatctgctttgcaaatggtccaatgtaaaacactcaaaacattggaattaatggatgccaagaaatttgacgatgaagatttgttggaggatattgaattcctttctgaacgtttgcacacttcagtgcaggatttgagctcttttgacgaatattgcaccgaaatacgctctgggagattgcaatggagtccggtgcataaatctgaaaaattttggcgagaaaatgcccaacgattcaatgaaaagaattttgaacttatcaaaatgctgattagactccttgacacaagtggtgatcctttggtgctttgtgtggccgcccatgatgttggggaatatgttcggcattatccgcgtggaaaaacaattgttgaacaataccaaggaaagcaggcagtgatgaaattgttgagtgccgaggacccaaatgttcgatatcatgcacttttagccattcaaaaattgatggttcacaattgggaatatttggggaagcaattggatgctgaaggaggaaatcgaagtgatgaggcgaaaagcgaaacgaagaatagaacttaaatttagatatattcacaataaataatattcaattcaaaaaaaaaaaaaaaaaaaaa

SEQ ID NO: 18 - DNA, 2128 bp, Pratylenchus scribneri
gggtttaattacccaagtttgagctcaaccagcttaattttcaaataattatgaacaataaacaacatgctgaaattacgccccaatatggggtttccttgccaatttgcacaaaaccaccaactgagcgtgatatgcgcctgactcgagagcttgaggaacatatgcgaaggtgtggattattcgaatcggatgcggatatgcaaaggcggctcgaagttttacggcgaatcaatatgatggtcaagaagtgggtgaaagaagtttcggtggacaaggtgccaccagatcaattggatcatgtcggaggcaaattatttacatttggatcatatcgacttggagtgcacacacctggagcggatattgactcattatgcgttgttcctcgacatattgacagatcggattttttcacatctttttatgaaaagttgaaagaggacgagaatacttccgatttgcacaaagttgaggatgcgtttgtgccagtcatcaaattgcattataatggcatcgaattggacattctttttgcacgcttagcactcaaggaggtgtccgacagtcaacaactttccgatgacaatttgcttcgaaatttggacgagaagagtatccgatctctcaatggttgccgagtagcggatgaaatccttcgacttatcccgaatcacagaaatttcattttaactttgcgagcggtcaaactttgggcaaaaaaccatggcatttattcaaatgtgctcggatttctcggcggtgtctcctgggccatcctcgtcgctcgaacctgtcagctctatccaaatgcagcacccgcaattttgctggagaaattcttcctcgtcttttcccaatgggaatggccttttccggtggttttgaaggatgcggatgccacatcacgaacggatatgccatattttgccgacatgatttgggacccacgaagccgaatttccgatcgataccatctgatgccaatcatcacacctgcgttcccggaacaaaattccacattcaatgtcacaaaatctacacggcaagtgatgatcaatgagttcaaagaaggtttgaatacaatgattgaaataaccaaaggcgaagctggctgggacaaactcttcgaagagatcaattttttcacccgttacaaacattttattgcacttctctgcgttactgcaaatgaggaggatcatttgattttcaatggccttgtcgagtccaaaattcgccatttagtcgcctcattggaacgcaatccctgtgttgccctttgccatgtcaatccgcgccaatacaaaccaaatcccactttgcatgtcgatattgattatgaaaacccagtttgcaccctttggttcataggattggaatttaatcgtgacctgcagaagagcatgaatatcaatttgacggatgaaatacaggcatttgttacaaacaccgtctccgtttcggcagccacaatgaaggacttcaaacagacaatgcaattgagacccgcctacaccaaacaaaaggatttgactaaatggcttaatttcgaggatttgaaccggggaaggcgtgtaatacggacgacgatcaaacgtccatcttccattttggattcatcagccgattctgccaatggttcgccgagtgcaaaaacacaaaaagtggaggccaacaacaacaaaatggaagtgaagaacaagaattgatcacagaaacatctcaaatcaaaacaatttcatcaacttcatccccaccgccagcagcagttttggaacaatgttagatcaacacattttgatgaacaatatttctttttcttttatgtattttaattattttgatgtgtaaaatacatattgtattaattttatgtctgtgttttttattttgttttaataatgggtttatttcaatcccacatttattttaattatattttctttattgatattttaataatgtatttttttaataaatatcatcttttaattaatcgtttaattatcatttttatatattttcatttttacactcactcaaaatttaaacatgatcttctttattccaaattttcacattatagtagcaacaaaaatgtaaaaaaaaaaaaaaaaaaaaaaaa

SEQ ID NO: 19 - DNA, 2039 bp, Pratylenchus scribneri
gggtttaattacccaagtttgaggttttttgcccttcaaagctattaaaagaaaggaatttagaagcgactctgctattaatttttttcctaatttctacaacatcaaattacatttcgacaataagcgatgggaataaaattcctcgaatttgtaaagcccttttgtgggtttgtgccggaagtttccaagccagaaaggaaaattcaatttcgtgagaaaatgctctggacggcgattacattgttcgtcttccttgtttgctgccaaattccactttttggtataatgtcaacggacagtgcggatcccctctattggctccgagtaattatggcatcgaatagaggaactctgatggaattgggcatttcaccaattgttacctccggtctaataatgcaattgttggctggcgctaaaatcatcgaagttggagacacgccaaaggagcgggcattgtttaatggagcacaaaaattattcggcatggtcatcacaattggacaggcgattgtctatgtggcatccggaatgtatggaaatccgcacgaaattggcgctggtatttgcttgttgatcgttattcaattagttgttgccggattaattgttttgttacttgatgaattacttcagaaaggctatggcctckgctcwggcatttccctwttcatcscaaccaacatctgcgaaacaatcgtttggaaagcattttcgccggcaacaatgaacaccggccgtggaactgaattcgaaggcgccgtaattgcccttttccatttattggccactcgaaatgacaaagtgagagcattgcgcgaagcattttatcgccaaaatttgcccaatttgatgaatttgcttgccaccgtactcatttttgccgtcgtcatatattttcagggattccgcgttgatttgccaatcaaaagtgcccgttaccgtggccaacacagctcctacccaatcaaattattctacaccagcaacatcccaatcatccttcaatctgcgctcgtctccaatctttatgtaatctcacaaatgttggccgccaaatttgggggaaatattctggtcaatttgcttggaacatggtccgattcatctggaacatatcgcagttatccaactggtggaatttgctattatttgtcgccgcctgaatcattatcccacatcctggaagatccaatccattgcctcatttacatcgtttttatgcttggctcctgtgcattcttctcaaaaacttggatcgatgtgagcggttcatcggcaaaagatgtggccaaacaattgaaagaacaacaaatgattatgcgcggacatcgggaaaagtcaatgattcacgaattgaaccgatatattccaacagcggccgcattcggtggactttgcattggggcactttccgttacggccgactttttgggtgcaattggaagtggtacagggattctgctggccgttaccattatttatcagtatttcgagatattcgtcaaggaacagcaggaaatgggcggcgttgctggtctcttcttctaattgattgaaaattgacaaagatgatccaaaaatgaactcttatttcgattttccacccaattacccattcattattaaaccttttttttatttcccacggacaaaaatgataatttatctttatttaaaaaagattttttgctctcctataagactattttgctgtcaattttcccccagagaattaatcatttagttattgttttttttgttcatcattatcatccaaaattgttgatgatttgatgcaaatatttttccccgatggccaattttgagttgtttttccttcatccacttctaccccaatagaacgcagaaaattacaattttccgcccttctctttacttgttttaaataaattatattgtatttcaaacgttttctcgatttttcttgttcaattcctcccatcctcccgcaaaaaaacatttggacaaaataaagagtaaaatttataaaaaaaaaaaaaaaaaaaaaaaaa

SEQ ID NO: 20 - DNA, 10333 bp, Pratylenchus scribneri
  modified_base (1)..(6300): a, c, t, g, unknown or other
  modified_base (7279)..(8120): a, c, t, g, unknown or other
  modified_base (9269)..(10333): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatgtcccttgacgatgccctccatcggggtttgatcgatccaaacagtgaatggattgtgccatcccgtgcatctggtgttggcccaaccattgaggaaagaacacaggaaacagtgacggaaacaggacaacaattagcaccaaaaatttatccggacaaggaactccaagagacggtgaacaccgtcaaacgggtgaaacgcacagaaacatccgcagttggaggacccggtggcgtcagtgtctatcgtgctgtgactggaggcaaaggctcgattgaagtgccagcttccggttaccatgtgttggaggcagaacgtaaaggccttttggatttgggcagaggcattgtgcatccacctgggacggataaatcattgagcctggaggaagcattcaatttgggcattttggatccacgttcaatcaacattcgagatccacaatcaggacgaaatctaagtgtggatgaagcaatgcaacaacgcattttggacaaacatggatttgtgacccatcacggacgaagaatgacattgcaagaggcaatcgatgaacgaattgcacacgtggagccagaatcgccggcaactattggtggagggcaaaacaaaaaagtgatccaattctcatcgaccgctggaccagctgtggcattccggccagttggaagaccggttgtggaagaatatgaacaatcctgggctttcgattcaaatgaaggaactttcattgatttggccacaaatgaacgaattccactggactctgccattcgttctggccgcatttcagccgatgatcttgtggcaagagacaccctgactggtcgagaatattccctggctgaagccgaaaaatggggaattgtgaacattcgagatggatattatttggacaaacagacacaaacgatattcatttgccgaagccgctcgcctccatcgaatttatccaacggtggaattcccgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggcggatggcctggaaaaaggcgaatattttgacccaacaagcaacatgaaattcacaattcaactccacggtgacccggtgaccacgcagacagcacaaagttcgatccacatcacaagttcaatccgtggaattggaaccgcacgccaatttgtgggcattgaccaaatcaaggatatgcgaaatggccgagtgatgtcattggccgatgcccagaggcttggcctggccagggtggatcgaaagggcaaacaaagcacaaaagaatatagcgcattccgttcaaacattgaattggcagtgaacaaaggcatcatggatggcagaggggaaaaactgtcattggaagaggcaattcgccaaagacttttggacattcgcgaattgaaatataatcatccacgaacaggggaagcaatcgatttgagcagtgccgcaaatcaaggccttgtggatgtgactttggccgaaactttgcccagcggagtacatcatccaggaactggggagaaaatcagcgtaaaacacgctgtggacattggaattgtggatggacgaactggcgaagtccggcatccattcaccggtgaaaaattgagttgggtggatttgacccggaaagtttacaatgcaatcacccaaaatggagtctacgatccccgaaagggatatgccgttccggtggcatccgcactgtccgaaggcctaatcgacacaagggccggcgcctacctgaatccaatcacgcaggaaagaatcacattggaggatgccaatcgacgtggcctcatcgactcacaaactttccatgcactcacaatgccatgtttgacggaccatcggtcacggaggaaaatgaatttggttgaagcggtggatgcccgattgattgacccaagggcaaaaacggttcaaatttcggccgatcgaattgtcccattgcaaaaggccgtcgatgatgggacaattccacgcgaaattggtgaacatttacggcgagtggacaaaatgacatttgccgaggcagtgggcaaaggcctaattgacgttgcccaagaccaattcacggatccggaaagtggcaaacaaatgagcattgccgaagccgtccaacatggattaattgacacgggaacagtgaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21 - DNA, 3011 bp, Pratylenchus scribneri
  modified_base (1)..(318): a, c, t, g, unknown or other
  modified_base (2712)..(3011): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttccattttgatgtgcatgaacagaaaattttggtcggatttgcacgtgaagttgtgccagccgaatcgccacagcaatgtttaaccgcatgcctggatgcattcgacacattcggttttgaatgcgaatcggtgatgtactatccggtggatgctgaatgtattttgaacaccgaggaccgactggatcgacccgatctatttgtggatgaacatgaggatacggtcatctatttggacaataattgtgccggatcccaatgttatgctccttatgtgacccaatatgtggcggttgaaggaaagcaattggcggatgaattggaccaaacttttgatggaattgaattggccgaatgtgaagagcgatgcactcaacgattgagcattacggccaatgatttcaactgtaaagcatccatgtacaacaatcaaacacgtcgttgcattctttcggatgaacgctccaagccacttggacgagcccaacttgccgatgcccaagcgccgggctggacctaccatgaaaaaaagtgttttgcctctccaagaacttgccacaatgttccatccttcactcgcgttcctcaaatgttgctagtcggattcgcctcattcgttatggaaaatgtgccttccgtgaccatgtgcttggatcagtgcacaaatccaccaccagagactgggcaaaattttgtttgcaaatcggtgatgtactattacaatgaacaagagtgcattttgaacgcggaatcgcgacaatccaagccagatttgttcatcccagaggaggacgattttgtggtcgactattttgacatcaattgccgactcgaagcagagcaatgtgtggatggtagaactccgaaattagttcgaacattgaatgcagcattgcccgaaggcgacggctcaatccatgtgctggaaacggtgcaggcaaatgtgcaggattgcgcacaaaaatgtgttgaacatgcccccgacaaatgccgctcatttaactttgacaagtcctcgggaacatgcaatctactttatttggatggtcgcggctcccttcgacccgaacttaaagctcaggtcgacctctacgatgttcattgcttgaacaatggccaacaaactgcagaagccggccattctccactgggttgcatcgatccagatggagccatattcagccgaaatctttacactcgttgggtcgcgaattcaccaaacaaagaattagccagccttcccctctccaaatgccttattttgtgttcaactgcagacgaacaatgcgaaggcgtcaattacaatcgacgcagtgtgcctgtcaatattcgcttcattgaatgcaccttctactacttctattcagcgccagagagagtgaacatgtcgacttctacagatgtttgtcgggtcagggaggaggtggccacaagggagggaagagaggaagatggccaaggccaaagtggcgcagcaaatgtcccaaaagtaccactcacagccaaccgttcctggagcggaacccacgaccaagggccccattcgaaattgaacaatcggacagcagctgctacaaaaaagccaactgttcgaattcccgaaatcccgaccaagaaatcaccaccaaaagagggaataaatccagaggaaacatcatcgaccaccaaacaacctgccgagtccacagttgccgtccaatttggagcaccaaataaaccggttgtaggaaatggtattgacgataatcaaatcactggacataagcctgtaattactgaaaatgttggcggtcgcattggtgtcacaaataaaggacccgatcccaatgaattgcctgctccggtgcagattccagccagtgaagtgcacacaatttgcaattatgagggcatttccgttcaaatcaaacattcggagccattttcgggcgttgttttcgttaagaacaaatatgacacatgccgggttgaggtggaggcaaaggaaagtgtcacattggtgctgggattgccagccaatttcggcatgaaaccaatctcgctgaatccaaatccatccgtgtctgccgccaaaaagaaagccaaagccaatgcagatgctacattggccgtggaaaattcacctcacaatgaatcatcaactaccgcgtccgattcatcttcttcagcggaaactgccgctgaagtggccgcccagcaacaacgtaaacgccatcgacgtcaaacacaacgggattgtggccttcaggacatggacaatggaacatacaaatcggtggttgtggtccaaacaaataatttgggcattcccggtttggtcacttcaatggatcagctttatgagatttcctgcaattattcgagcatgttgggtggaaaagttcaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22 - DNA, 1926 bp, Pratylenchus scribneri
gggtttaattacccaagtttgagattattaatacattcaatagaaaatcaaatggatttattgcaagcatacaaaggtgattcttcttcatctgatgaatgtgacgacgacgtatcaatgagtgaaggtgagggaaccagtggcatcaatttggctccgaaccgcagtgaagaaaaatatgcattggctcttcccaaagtggatttggcaccgcaagtaatagcacatcaaccaatacaaaccgtggccgttgttgatccaaaaaccaaagagctctattacaatccgaaatacgaagaactcttccaacctgagaccggtccacaaaaccctttcaaaagtgaacatcaaagagcaccgaaaaatatgctgaccggatatgtggaaccagcgcatttcaatcaattccatttcgaacgtgccatccgctcatatgacacacttggttatgcagaaaatccatcagcggatgccgggaatacatttgtcggagatgtgaacaaagcaaaggaagaaggtggcaaatcgctgtttgagtcgaaaaaaaccggcgggcaaaagcggaagaaagtggtcaattacgatgcgtcggacattgatggctacaccggtccatgggcccgctatgaaaatgagaagacggtggccaaacccgacgcggaacttcaaaaggaaatggacgagattgtgcaaaagcggaagatgaagagccggattggaaggaaactggccgttgaagaattgcatttggccgaagagagcacaaaactgcacatcaaagatgacaaggactatttgggccgttcattcatggaagcaccgaaaagtgttggagtcaatcttcgtccggaccatgtgcccgaaaggtgctatccaccgacgaagcaggcccatacctatgccggacatacaaaaccggtcacagccatccgatggttccccaaaagtgcgcatatgttcctttcgtgttcgatggatggaaaagtcaaactttgggaagtttacggcaaccgaaaattgattcgcacctatacggggcataaagtgccagttaaagacatttatttcaacaatgatgggactgaatttttgactgccgcctatgataattatattaaattatgggacaccgaaacaggacaagtcaaatcacgattcacaattggcgcgcatcgagcctatgtgattaaattcaatccggatggggacaagcagaatttgtttattgccggaatgtccaacaagaaaataattcaatgggacactcgcagtggggaaattgaacaggaatatgatcgccatcttggcccagtcaattccattacatttttcgataaaaatcgtcgattcgtctcaacttcggatgataaatcacttcgcatttgggaatttggtattccagtggacacaaaaataattcaacatgctggattgcattcaatcccatcaatgacaagggcaccaaatgagaaatggattgttggtcaatcgatggacaatcgaattgtccttttccaaattgtcgatgacaagcttcgatttgcacgaaagaaggcattccgtggtcacaacaccgccggatatgcatgcaattccgatttttcaccggatatgagtttcctaacatccggtgatgcggacggaaaaatcacaatttgggactggcgaacgcataaaattgtttcaacatggaaaggacacgacaatgtttgcatttccgtcctatggcatccacatgaacaaaagaggatgatcagttgcggttgggacaattcaatcaaaatgtggttttaaacaatacaatcgataaaattccattttattctgttttatttgtattcaattcatcaaacaatattttatttttttttatcaataaaatttgagaatatcaaaaaaaaaaaaaaaaaaaaaaaaaaaaaaaaa

SEQ ID NO: 23 - DNA, 1160 bp, Pratylenchus scribneri
gggtttaattacccaagtttgagttgaaaaatctaaaaatgacttgttcctatattgcatttgctggctacattgccatcgtctacgcattattaaaattgcttcgatccgtctacaatgttgtgttcccatatctttttgcggtgccacaaaatcttcctgtactcgccggagcaaaatgggctgtggtcactggcagtactgatggcattgggaaggcttatgcacttgaattggccaagaagaacttcaacctggtgcttatctcccgctcaatggacaaattgaataatgtggcagaagaaatccgcaaaaaattcgaccatattgacgttaaaacaatttcattcgacttcacaaacgcccaattggatgattatgagaagacaattttcaatgaacttaaccagctcgaaattggtgttttggtaaacaatgttggaatgagctatgaatatccggaacgtttcgaccaagtcgagggtggattaaagcgcttaacagacataacagtgatcaacaccgtccctacaactgtgctttctgcctttgttctcaaacaaatggcaacccgtcatcgaggcattgtgatcaatgttgcctcctcggctgcatattttgattggttctatttggctgtttattccgcaacaaagaaatatgtctgctggctttcctcaattcttcgcaaggaatatgccgacaccggaattattgttcaaaccgtatgcccgatgatggtggccaccaaattggcgaaggtccgcaaagcatctttcttcacaccaactcccgaaaaatttgcctacgaagcagtgcgaagcattggactcattgaggagaccacgggctgccttgctcatcaaattcaggcagaaattatgttcggctatgttccaacattcttcttgaacaaatttatgaaggacaattcactgcaaaccaggaaacgtgcattgaagaagaaagaggcggcagctgtgtcggaataattgaatagatgatgagaagggaatgatatttgacaattgagaagaaaaaataatagtgagaatagagcaatatatttttatttaagtttattatttattcatttaattgaattttgatggaacaatttaataaaaaatgaatttaattcaaaaaaaaaaaaaaaaaaa

SEQ ID NO: 24 - DNA, 970 bp, Pratylenchus scribneri
gggtttaattacccaagtttgagattatcaatcatttaaattagagcgaaaattgagaaaaaataatgttccgaaatcaatatgacagcgatgtgacagtgttcagcccgcagggtcgtttgcatcagatcgattatgccgtcgaagcaatgcgtcaagggagtgcaacagtggcaattcggggcaaagatcatgcggttgtggttgctctcatgcgggcccagaatgaactttcatcatatcaacaaaagactttccaattggacgatcatgttgggctttccatgtcgggtctgttggccgatgggcggattttggctcgcttcattcaaggagaatgcgccagcttcaaatgggagaatcagacagccctttcaatttcggatttgcgcaccaaactcattctgaaactgcaagagaacacacaatattacggccgccgcccatttggtgttggacttctgatcattggatacgacgatcttggcccaggcccacatgtgctcagcgctgatccatccggaaatgtcgaggaagtggtggctgccgcaattggtgctcgttcacaaagtgcaagaacctatttggcgaatcataaggacgacttcagggaggccgacttggacaacgtcatcaaacacgcccttcgagcgctgaaagagacattggcaacggatgctggcaaactggatgagcataatacagcaattgcggtcgtcgggaaacgccagaagtttgaatgccttgaacgcgagcaggtcaagacccatattgctgatatcgacggtgcaaatggtggtggaggggatcaacaaatgcaagaataaaacattcgatgatgcacatggaatttattggatggatgacctattttgtttggacaatatcaatattatttaaattgtttttttttctcttttttgataaatgtttttgattttgaaaaaaaaaaaaaaaaaaaaaaaaaaaa

SEQ ID NO: 25 - DNA, 1883 bp, Pratylenchus scribneri
  modified_base (1686)..(1883): a, c, t, g, unknown or other
gggtttaattacccaagtttgagagaccaaaaaagaagttaattttgcatccaagttgtaagaatatgccgccatcaacaagagacggagtcaaggaagcccaatatggatttgtttacggcgtttcagggccagtggtcaccgctgaaaaaatgtctggcgcagccatgtacgaattggtccgggttgggcattccgagttggtcggcgagattattcggcttgaaggcgactatgcgacaattcaagtttatgaggaaacttcatccgtcacaattggcgatcccgtcttgcggaccggaaagcctctctccgttgaacttggccccggcattatgagctccattttcgacggtattcagcggccattgcaggacattgcggcgatgacaacgtccatttatattccaaaaggaatcaatgtgaatgcattaagccgatcaaaatcatgggaatttgagccaagaaagggcgtcaaagtaggcgatcacgttaccgggggcgatgccattggtttggtgcacgaaagtatgctggtcaaacacacaatcatggtgcccccgaatgcgtgcggaacaatcaaatacattgcaccaaaggggaactacaatgtcacggacattattttggaagtggaattctctggagacgtccaaaagtttccgatggtccaagtttggccagttcgccagcctcgaccagtggcagaaaaattggccgccaattatccgttgctttgtggtcaacgcgttttggatgcactttttccctgtgttcaaggcggtacaacggcaattccaggagcttttggatgcggcaaaaccgtcatttcccagtcactttcaaaatacagtaattcggatgcgatcatctatgttggatgcggtgaacgtggcaatgaaatgtccgaagtgttgagagattttcccgaattggaaatggaagttgatggaaaaaagacgacaattatgcaaagaaccgcattggtggccaacacatcgaatatgcctgtggccgcccgagaggcatcaatttataccggcatcacccttgccgaatatttccgtgacatgggcctgaatgtggcgatgatggccgattccacgtcacgatgggccgaagctttgcgtgaaatttccggtcgtctcggagaaatgcccgccgattctggctaccccgcctatttggccgcccgtcttgcctcattctacgaacgtgccggaaaagtgaaatgtcaaggttcacccgaacgtgaagggtccgtcacaattgttggagctgtttccccgcccggtggtgattttgccgaccccgtcacttcggccaccctcggcattgtgcaagtgttttggggattggacaagaaattggcccaacgaaaacattttccctcaatcaattggctcatttcgtacagtaattatatgcgcgctctggacgattattatgagaagaatttccccgaatttgtgccacttcgaacaaaatgcaaggaaattttgcaggaagaggaggaactgtcggaaattgtgcaattggttggcaaagcctcattggccgaatcagacaaaatcacattggaagtggccaaattgatcaaagacgatttcctccaacaaaatggatacacaaaatacgatcgattctgtccattctacaaaacagttggaatgctcaaaaatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26 - DNA, 3579 bp, Pratylenchus scribneri
  modified_base (1)..(54): a, c, t, g, unknown or other
  modified_base (2261)..(3579): a, c, t, g, unknown or other
nnnnnnnnnnnnnnnnnnnnnnnnnnnnnnnnnnnnnnnnnnnnnnnnnnnnnngatgaagacgacgaaatttcaacagaattatggcaagaagcatgttgggttgttatatcggcatattttgatgagaagggtttagtgcggcagcagcttgacagtttcgatgaattcattcaaatgatagtacaacgaattgtggaagattcgccagcggtcgaactccaaacagaattgcaacattcagctggagaaattgaagcacccacgaaattctcgctgaaatttggtcaaatctacttgtcaaaaccaacgcattgggagaaggagggtgcaccgacaccgctgatgccaaatgaggctcgactccgcaacttgacctattcatctcctctttatgtggatattgtcaaaacaatctcgaaggaaggcgaagaagatattgtgcaagaatatccgaaagttttcattggcaaaattccaattatgctacggtccagctattgtgttctctccaatttgactgatagagatttgactgagctgaatgaatgcccattggaccctggcggctatttcataataaatggaagtggaaaaatgttgattgcgcaggagaagatggcaacaaatacagtttacgtgtttgcaatgaaggatggaaaatacatgtataaaacggagtgccggtcatgtttagaacattcaagtcgtcctgcttccactctttgggtgaatatgacgaacagaggaggcaaaggtggaaagaatccaactgggcagcgaattgtggccataattccttacataaaacaggaaatcaatataatcatcctgttccgcgctttgggcttcgtctctgatcgggacatcctcgagcacattatttacgattttgaggatcaagaaatgatggaattgctcaaaccaagtttggatgaggctttcgtcgttcaagaacagtcggtggctctgaatttcatcggcactcgaggggcaaaaccaggcgttaccaaagaagcacggattagatatgcaaaagaaatactccaaaaggaaatgttgcctcatgttagcattgctgaacattgtgaaacgaagaaagcgtatttccttggctatatggttcatcgacttttgctggccgcccttggacgtcgagaattggatgaccgtgatcatatggggaataaacgtttggatttggccggtccattgcttgcttcactgtttcgagcacttttccgaaatttattaaaagaggtccgtttaactgctcaaaaatacataaacaaaaacggcgatttcaatttggatgtttgtgtccgcccaacaattattacccgtggtttggcctattcattggcaaccggcaattggggcgagcagaaaaaggcacatcaaacacgggcgggtgtcagtcaagtgctcaaccggttgacctatacggcaacactttcacatttgcgccggtgcaattcaccgattgggagagagggaaaattggcaaaacctcgtcaactgcacaacactcaatggggaatggtttgtccggcagaaacacccgagggccaagccgtgggattggtcaaaaatttggcattgatggcctatatttcggtcggctcaatgcccgaaccaattttggaatttttggaagaatggagtatggaaaatttggaagaagtttcgccattggcaattgcaaatagcacaaaaatatttgtgaacggttcatgggttggcattcatcgggacccggaccaattgatgacaacccttctcaaattgcgacgacaaatggacataattgtcagtgaagtcagcatggtccgggacattcgtgatcgggagattcgaattaacactgacccgggacgagtttgccggccattgttgattgtgagtgatggaaaattgatgctcaaaaaacgacacattgaattattgaaggaacgagacaatgccgaaactccattcacatggtcagacttggtccaaaatggagtggttgaattgatcgacgcaatggaggaggaaacaataatggtttcaatgacgccggaggacctgaaatcgggaggatattgtgaaacgtacactcattgtgaaattcatccggccatgattttgggtgtctgcgcttccatcattccattcccggaccacaatcaaagccctcgaaacacatatcaaagtgcaatgggaaagcaggcaatgggcgtttacacaacaaatttccacgttcgaatggacacattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27 - DNA, 2273 bp, Pratylenchus scribneri
  modified_base (1050)..(2273): a, c, t, g, unknown or other
gggttaattacccaagtttgagaggtaaattctaatttcattttctggaatggaaagggacggcactaatatccaaaggcaaagacaaaatcaacgacgaattgcatcaagcaatattaggtcaagaccccaaagccaattaccattatcgaattcattcattttgctcctaatttgtcttttgccccatcctttgttggccatttttgaatgtggcccacatgagacggccacattcgttcgaatttcccgggcccgtttggatggcaccccgttggtcgtgtccactgccggtcatgaccttacctgctcccagtattgccggaataacattgagccaaccaccggtgctcaacgcttttgtgcctcattcaattttgatggccgcgaaacgtgctacttctttgatgataccgcagcaccagtggctggtcaagccgaattgaacccaaacccatctgccaacaatttctactatgagaaaatgtgcttgcccggcctgaactcccatgaggcatgcacatatcgatcattttccttcgagcggatacgaaaaactgcgttggaaggattcgtccgcaaaagtattcaggttgcaagccgagaacaatgtttgagtgcttgccttaaggaaagggaattcgtgtgccgttccgtcaattacaactatgacacatacgcatgcgaaatgagcaccgaggatcgccgttcaaagcccacaaatttgcgaatgatggatcagccggtggactatttcgacaacaattgcctcaatcgtcaaaatcgttgtggccaacaaggtggcaatttggtgttcgttaagaccacccaattcgagatcaaattctacgaccatacccagtccgttgagccgcaagagtcgaattgccttcagaaatgtttggactcgttgaacactttttgtcgttccgtcgaattctcgcccaacgagaagaattgcattgtcagcgacgaggacacattctcccgtgccgatcaacaagccgccgtccagtccaaggattactatgagccaatttgtgtttccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28 - DNA, 1860 bp, Pratylenchus scribneri
atgacatctaataacgacattgttgctcaacttcaagatgcggccaatcgaatgagagtttcttccattgagcaaacatgcaaagcaaattcgggtcatccaacgagcagttgcagtgccgctgagattatggccaccttgttttttgcggaaatgcgttacgatgtgaaaaatccgcgacatccggctgccgatcgcttcattctatcaaagggtcatgcctgtcctatcctttatgctgcttgggaagaagctggtctgctcaccaatgaccaagtgctcagtttacgccgaattgactccgatattgaaggccatccgacaccaagactcaatttcattgatgtggccacaggttcacttggtcaaggactttcttgtgcagctggaatggcatatgctggaaaatatgtggacaaagcttcgtatcgtgtttattgccttatgggtgatggcgaaagtgcggaaggcagcgtttgggaagcagctgctttcgcaagttactataaactggacaatttggtggcaattgttgatgtgaatcgtcttggacaaagtcaacaaacaatgttgcaacatgaccttcaaacatatacaaaacgattcgaggcattcggtttcaattcaattgtggtggatggacacgatatcaacgctttagtaaaagcatatgctgatgcaaagaataccaaaggaaaaccaacagcaatcgttgcaaagaccttcaagggcaaaggcattgacggcgttgaagaccaagatgattgccatggaaagccggtgaaaatggataaggccgaccaaatccgagctattctaaaaagcaaaaccccggtcaaatggaacatcccaaagccggtcgaggatgccaaagaagttgatctgggacttggcagaatcaaaatgagcaaaccaccgcaatatgaaattggccaaaaggtggcaacccgtctggcctatggcgatgctctcctcaaattggccgatgtcaacaaacgtgtcattaccttggatggcgacatttccaattcgacattctcgaacaaagtattgaaaaaatatcccgaccaatttgtccaatgttttattgccgaacaaaacatggtcggcgttggtgttggtttggcttgtcgagggcgtgccatcccccatattagcacatttgccgcattcttcactcgatctggcgatcaaattcgcatggctgcagtctcttttgcgaacgcaaaattcactggttcacatgtgggcgtttcaattggtgaggatgggccaagtcagatgggccttgaagatattgccttgttccgtgcactgcctgacagcattgttctttatccttcggatgctgttgccgccgaatatgccaccgaattggctgccaattacaatggaataacatatacacgagttagtcgtccaaatacccctgtcatttatgctaacaatgagaagttcgagattggaaaatgcaaggttgttcgagaagctccacaggacaaatttatgctgattggcgccggtgtcacactttatgagtgcataaaggctcatgatgaactcaaagctgatggaattaatgtttgcgtggttgatttattctcggtaaaaccactcgatgtcgaaatgctaacaaaacatgcccaacgagttggtggtaaagttttgactgtggaagatcattatcaagctggtggactgggtgaagcggtggccatggcattggcagatattcccaaygttcgtgttcgccacatttgtgtcaaagaactcccacgttctggaccacccgatgcattgttggayttatatggcctcagctcaaagcatattgttgccgctctccagaattatgactag

SEQ ID NO: 29 - DNA, 1764 bp, Pratylenchus scribneri
  modified_base (1)..(474): a, c, t, g, unknown or other
  modified_base (1636)..(1764): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcgcaaattgaggtcatcccttgcaaagtttgtggtgacaaatcctccggtgtccattatggagtgatcacctgcgaaggatgcaagggctttttccgccgttcccaaaaccaccaacatcccaactaccaatgtgcccgcaacagtaattgtcccgtggaccgggtcagccgaaatcggtgccaatattgtcggctgaagaaatgcattgaattgggcatgtcccgagaggcggtgaaatttggccgaatgtcgaagaaacaacgcgagaaggtcgaagatgaggttcgcctgcacacccaacgcagtggcaccgatttttccaccagtgccccgttgtccacgcctccggccatttctgcctctggccaatatcatcagcaggcacatttcatgtcggctcctccttccgtcgggccaccaacgccgggcagttcagccggagtggaaattaaatatccacgcacgccaatgttcgccggtatttatggccaagtggttccaacaggtccattccacgtgaatggtggcgaaggaagggaagaagaccaacagcaacaaattctccatcttcacaatgcacagcacggccaccattttattggtggtggccacccccttggccaacagcataataataatggtggcacccaacaacaattggtgttgggccagccgagttgttcctcagcatctgtctcttccccattgatttattcacaacaatcgcaacaacaaatgctgccacatgcctgcgctccaatttcctattccctgatgcccagtttttgtcagcaacagcagccaattgcacaacagggcgccgtcccctcaagcagcggtggctatccaatccatgaatccgaacttggaatggtccattccagcaatgggcatgtgtcatcaacggtggatgatgatttgattaagcaagtcagtcgagcctatgaaattgcgcatcgtttgccgcgaccttcctttgaagattggcaaattgatgcgcaacaagtggatcgcctcaaaaatatgagtcggttgaatggttggctaaaatttgccaaggagctgacagatgtgatcaaatcaatcattgaatttgccaaggctttgaatgaattcaagaaacttggccaagaagaccaaatcaatgccctcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30 - DNA, 1344 bp, Pratylenchus scribneri
  modified_base (803)..(1344): a, c, t, g, unknown or other
gggtttaattacccaagtttgagattaaataaaaatggtggttcattatcatttgagattggcaattttgcccactgaatgcctaaatcaatgtcaaaaattgtcgacatttacacaaaattcgctgggaggattgtgtttttcaccaacaaatccatttatggaacaacgccgcacaattgttgacaaatacactttgccttccacactgccttacaattatccagagccatatccgtacaaagaaaaaggcttccaacgtcatcaaattataccatcccggagtttaattcgccatcataagaattcaaaactaattgtggtcgaagggaatatcgggagtggaaagaattttgctgccaaattagccgatgaacttggattcctttatatgccagcattctcgatgaaagatattttggttgatcgttatgggaatgatatgcgcaaattccatgatttgttcccaaaaagattccgaatacccgatgagctgatgttctacaaaaatccttcggatgatcaaacagcagttatgcaggacctcatctatgcaagcaaattcgagcaatatgcaaatgcgctcgcccatatattcaatacaggtgagggcgtcgtaatggaacggtccgtgtacagtgatttcgtatttgcaaatgcaatgcgcgagaagaattggattagcatggaatttttcaaatattatcattttgttcgaaaagtcactctgcattatctgcgattttggcctcatttggtcatttatttggactgtccaatctcaaaatgtttggagaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31 - DNA, 1229 bp, Pratylenchus scribneri
gggtttaattacccaagtttgagcttcagttcaaaatgacaaataaaacattgaaaagcattaggcctccaacggcattattccttctacaaatttctgccattttcttctcaacttttttattggtcaatgtcagaggagtcgaggtccatttcgatagtgccgacaaagttcagggacaattgccaattgtgattccgcaaggaaaaatggaaaaggaaggagacaaagaaatatacaaaattgaaatcaaggaccatacaaagccatgcctattttatgctgaatcaatgtcagttgtgctctacgatttcaaggaaaaaaagcaatcggcctgggcaactttgaacatgaccaatacaaaaggatttgtgggagattttgaatgcccaaaagaagggagcaatgttggcaactcattcagagttgatttgacggtcaatgccaacgatgtgcccggctattattccagcgatttggtccgaaaggatgagagcagagttattttcaaggtttccaaagtggatatcagtctcattttcaatttcacccaaccggcctattggaaattggtcgatgcgaccgtcaacgaaattcaattgagtgatggagcagcgacaggacttccgaaaatcggctctgatgccaaattggtgaccggccaaggcaaagattggaattttgcggacaaacatatgccggcatggaatatcaacgggttcaaggattatgcctattcatgtgcccggacaaatccaattgtttgggccacagaggaaaacaaaaattatgcggtcggggtcactctcaacaatattcagatgcaattgaatgccacatcgcagagagaggaaggtggcaaaaattatgcccgattcggtttccgagtcaacgattgtgccccactgttcagcattggcacttggatgggcgttattgtggcattattactgattggggttttgtcatttggctttttgatgctaaattccgttcaaacaatggaccgattcgatgatcccaaacaaaagcagttgattataaatgcaaaagaataaataattggcacccaacgaaaatgattcgagaacgaatgaaaacccggaaccatgaccttaaatttttattattttcccaatgagaatattttttaaaataatttacgaaattcattcccttttattagatttaaaaatataaagttttgattaaaaaaaaaaaaaaaaaaa

SEQ ID NO: 32 - DNA, 499 bp, Pratylenchus scribneri
gggtttaattacccaagtttgagaaatgatccattatatgtttcttttttctcggcaagggaagctacgattgcagaaatggtatgtcgcctatccggataagaataaaaagaaaataacgcgtgaattgattacaacaattttggcaagaaaaccgaaaatgtgtgcatttttggagtataaagaattgaaaattgtctacaaaagatatgcttctctttattttctttgcgccgtagaacaatccgacaatgaattgctttgtttggaaacaatccaccgttatgtggaattgctggaccgatactttggcagtgtctgtgaattggatataattttcaactttgaaaaggcctattttattttggatgaatttttattggcaggcgaaatacaagaaacgagcaaaaaacaagttttaaaggcaatcagtgcacaggatttactgcaagatgaggaaacaacacaaggattttttgaagataatggtctcggctaa

SEQ ID NO: 33 - DNA, 1125 bp, Pratylenchus zeae
ggaataaacgaagagctgtgcaatgcctgcgaccggatcggctggagcaagccaatgccaatccaagagcaagtcatcccggcggcactcagtggacgtgatgttattggacttgccgagactgggtccggaaaaaccggcgccttcgcccccatcctccaagcgctcatggactgtcagcaacggttgtttgccgtagtgttggcgccaaccagggagctggctttccaaatcacggaacagtttgaggcgcttggggccagcattgggctgcaagtttgcacaattgtgggcggcattgaaatgtccacccaaacgctgtccctctccaaaaggccgcacgtgattgtggcaacccctggccgcctggtggaccatttggagaacacgaagggcttcgacctgcgcaccgtcaagtacctggtcatggacgaagccgaccgcatcctgaacatggactttgaggtggagttggacaaaatcctgaaagtcatcccgaagacgcgcaaaactctcttctcggccacaatgacacaaaaggtttcgaagctggagagggcgcacttaaagaacccggcccgggtggaattgtcctcaaagtaccagacggtcagcacactcatccagaacatgctgttcattccgttcaaatacaaggaagcctacctggtgtacgtgttgaacgagaaggccggcaacaccgccattgtgttctgcagcacatgcgccagtgcggtcaaaaccgcgttgatgttgcgccacttggggtttggcgcgattgcattgcatgggcaaatgtcacagccaaagcggctgggcgcgctgaacaagttcaagaagaaggaccggtccattttagtttgtacggatgtggcttcaagaggtctggacattccccacgtggacatggtggtgaactacgatgtgccggcccattccaaggactatgtgcatcgggttgggcgaactgctcgagctgggaagtccggcattgcgctcaccatggtgacccaatacgatgtggaaatctaccaaaaagtggaggcttccatcgccaaacggcttgacccgatggaggtgaaccacgaggaggtgatgcaactggtcgagcgggtctccgaggcg

SEQ ID NO: 34 - DNA, 1425 bp, Pratylenchus zeae
atgtcagtaaaatttctggaatttgtgaagccattctgcggcttcgtgcccgaggtctcaaagcccgagaggaaaattcaattccgggagaagatgctctggacggccatcacattgttcgtcttcctcgtctgttgtcaaattcccctattcggcataatgtccacagacagcgcagaccctctctattggcttcgagtgatcatggcctcgaacaggggcactctcatggaattgggcatctcgcccattgtcacatctggattgataatgcaactcttggccggcgcaaaaatcatcgaagttggggacacgccaaaggaaagggcgctcttcaatggggcacaaaaactctttggaatggtcatcacaatcggccaggcaattgtctatgtcgcatccggaatgtacggaaatccacatgagattggcgctggcatttgcctgctcatcgtcatccaactggtcattgctggattgattgtgctgttgttggacgaattgcttcagaaaggctatggcctcggctctggcatttccctgttcattgccaccaacatttgcgaaacgatcgtctggaaagccttttcgccggccacaatgaacaccgggcgcggcactgaattcgaaggagcaatcatcgctctcttccacctgctggctacccggaatgacaaagtgcgcgcactacgcgaggctttctaccgccagaacttgcccaatctgatgaacttgcttgccaccgtcctggtctttgctgtggtcatctacttccaagggttccgcgtcgacttgcccatcaaaagtgcccgctaccgtggccagcacagctcctacccaatcaagctgttctgcaccagcaacatcccaatcatcctgcaatctgcgctggtctccaatctgtacgtcatctcccaaatgctggcaaccaaattcggcggcaacattctggtcaacctgctcggccagtggtccgactcgactggcacctaccgcagctatccaaccggcggcctctgctactacctgtcaccaccggagtctctctcgcacatcctggaggacccaatccactgcatcatctacattgtcttcatgctcggctcgtgcgccttcttctccaaaacatggattgatgtgagcggctccagcgccaaggacgtggccaagcagttgaaggaacaacaaatgatcatgcgcggccatcgcgagaagtccatgatccacgaactgaaccgatacatcccaaccgcagcagcattcggcggactttgcattggcgcattgtctgtcacggcggacttcttgggagccattggaagcgggactggaatattgctggctgtcaccatcatctatcagtatttcgagatattcgtcaaggaacaacaagagatgggcggaatttcgggcctcttcttctaa

SEQ ID NO: 35 - DNA, 3462 bp, Pratylenchus zeae
gggtttaattccccagtttgagatttatgcaacgtttcaatactcttattgttgatccagaagaaccagcaagcaaaaaagcgcgagttctcggaaacatacaactttgtgacccgaaaaacaacggaacagtgatgccggctcaagacaccaatacaaacaataattcggccgtccaacatgcgcgcaatggcggcggacatggagaccacgactctggtgttgacactaatctctactcgcgtcagatttacgccttgggagagtcggcgatggctcatctgcgcaaagcttcggttctggttagcggtcttggctcagttggagttgaaatcgccaagaatcacatactcggcgaagttcgtcatgtcacacttcacgaccaaaaggatttgacttacaaggacttgtctgcccatttctacgcaagcgaagctgatgtgggccacaaccgggttcgaatttgcgccaagcagttggccgaactgaacgacactgtcaactgcgcggtctcaacggatgcactcacagaggagtttgtcaagcaattcgatctgatcgtccttactgactcaccctgggagctgcaaatccaggtcaatgattggatgcgcaaacacgggaagatgttcatttcggctgatgcacgtggcctcttctcctatgcattcgtggacttgggcgatcaatttgctgtcactgacccggatggagaggcttgcaaagaggtcttgcttgagcacatcaattgtgagacgggtgagatattcacactggagggaatttaccacggactagaggatggtgatcacattgtgttcgaggactttgagcagcaggaactcaacgaactgaacccgattccaatcaagactactgcaaagggcaatatcatgaatgtgggacaagcacttgcccaatacaaatctatgttggaggcaccactcacacgcggacgtgcaaagcaagttaaagtgccgaagaatgttgcgttcaagtcgttggccgaagcactcaaggaaccggaaatcctcatttgggactttgcaaagtttgatgagcccgctcaacttcacttcttatggctagcgctctaccagttcgagaaaaggcacggccgctctccaaaaccacgctcaaacgaagacgcccaactcctgaagaatgagctgccatcaaatgcgccagaaattcccgacaatctgttgaacaatttctcatatcaggcaactggaaacctgcagcccatcgcttcagtcattggcggttttgtggcccaagaagcgatgaaagcagttactcaccacacaactccattgaagcagtttctctacactgactcgttggaagcgcttcctggcgactattcccagtttgatgcggcaaaattgacaccgaaagattgtgcaccgcgcaaaagtcgctacgatggacaggccgccgtctttggttgggcattccaagaggcgctggaacaacaacactggttcattgttggcgccggcgcaatcggctgtgagctgctgaagaacatggcaatgatgggactggcttgcggagaaaagggccaattgacaatcactgacccggacacaatcgaagtttccaacctgaaccgacaattcctctttcgacgaccggatgttgggaagcgtaaagctgaagtggcggcccgagcaattacgggattcaacgcagccgtgaagatccgcgcactgtccgacattgtttccgaggccaccgagaatgtgttcaacgacgacttcttcctcgacctgcatggagtgtgcaatgccctggacaatgtggaagcacgtcgttacgtggatcgtcgttgcgtctactaccagctgccgctgctcgagtcgggaacaatgggcaccaagggcaacacacaagtgatcttcccacatctgaccgaatcttacagttcctcaaatgatccgccggaaaaagagacgcccgtttgcacgctcaagaacttcccataccagattcagcataccatccagtgggctcgttcgaaatttggcgactacttcacatccactgctgagacagccaaccagtacttggacgatgttaccggctttctggcgcgcctgaacacaatggcaccgtcacaaaagatcgaagttttgcgcgcattgaacaaggccctcattgacgagtgcccaaagagtgcggaggattgtgtcaattgggctcgagagttgtttgaccagcagtaccggaatgaaatcatgcaattgcttcacaacttcccggctgatcaggtcacttcccaaggcgtcagattctggtctggcacaaagcgttgcccgcgtccgctgaccttcaacgtcaataatgaagaacatttgcaattcatctacgcggcctccatccttcgtgcgcaactttacaattttcagccaatcactgatcgtgcccgtgttgctcaacttgctgctgcttttcagtccaaaccgttccaacccaaggaaggagttcgaattgctgtcactgacgcggaggcggcaaatcaggcggagggtggcgaaccagatgggaatgcagatgttgttgagcgccgcgtggacgagttgagtgtccgtttggcccgtcctccaattttgcaaatccagcgactgaatccaattgactatgacgaggaggacgacgccaaccatcacgtggacttcataaccgctgcttcaaaccttcgcgccgaaaattactcgattgagaaggctgatcgcatgaagactaaacaaattgccggcaagatcatccccgctttggccacaaccactgccatggtctcgggccttgtgtgcattgaactctacaaaaccatcgaggctgacggtctgcgctcgaatgcacccattgaacgctacaaaaattctttcctcaacttggccatcccgttcatcgcgttcagtgagcccggaaaggcgccgaagaagaggtaccgcggagatcgtgaatttacgctttgggatcgtctggaagtgaatggtccgaaaacaatgggacaactgatcgattggattgagacggaaaccggcctcaccgtgtcaatgatgtcttccggcgtctcactgctttttgcgttcttccaaccgccagcaaaggtgcaggaacgccgcgcaagagacattcttgccgttgtggaggaagtttcgcgcaatccagtgccggactatcgtcgcgccattgtactcgaagcgatcacaaacaatgaacaggatgaagacgtggaaatcccctacatcaagtacaacttccgatgagcgcaattgatgcaagaatgatgacttcaaactgacggactatgaattttctaaatcaagacccatctttgttcgcaaactactaaatttgttttgtttatcgataatttccttcccgttacattgaccttttcgttatttatttggagataaagacttgattcagcgaaaaaaaaaaaaaaaa

SEQ ID NO: 36 - DNA, 8812 bp, Pratylenchus zeae
  modified_base (3086)..(3086): a, c, t, g, unknown or other
gggtttaattacccaagtttgagcacgtacagcaccacacaaagaatatttttttttgattggaatttgagccaaacacacgtagaaaggcaaaacatttgaataagacaacccaaaagctgtacaacacgccatgtacaaggtgcttcagaagtacacgcgcaagcgcaaacacgaacaacatggttctggcagtggcaaggacgggggtggaccgccaaggggcggcagctactcgtacagccgctcccgttcagaaggtgccgtcaatggcgcgccgccgccaccgcctgtcggtgccaacggttactacagtcaacaccagtccagccaacaacaagtccatcgaaatggaggcgtccatcacagtggatcccaacaacatctcaaacgcagtcaacacgccgaggaagccgctttccatgagcgcagccgaagccgtggcggtggcgaataccgcaatggatttggcagtcatcattcgggttcgatgcctccgcccggtgctgtgacagaacgccagcacttttatgatgctgcaacgggggcacacggcttccaggagaacaccagctgggaaaccaaggaacactttgagcggaaagtgcaaaaggggcagaaaaggtcgggaagccaaatgcttggtgggaccaaggagggctcacgcgcacgattggaccaatggagcagcagtgggttggccattgacagaggcaacctcgatgatcttgtgtcccgactcacacgtggaattggaatcaccaatgaggagcttgatcacatcctcacacgcatcgatgccgtcgacgcagcagcagagcgtggcgagcgtgtggaagtgcttgagcgtcagattcgtgaaattgtcgacgacctttatgccctgaaaccgcccattgatgaattcttcgttgatgtggaaacattgcgccaacatcggcatccggaggcggcagatttccacaaacaagtgcttggacttgaacagcgtcgcactgcctatttgggacgccttgaagacggcatcatggtccgtctcggcattcgctccaacaagccacagttcatggaacgctacagctccacccatgtttcacaggcccacaagggcaatgccttccgtcgggtggaagatgccatccaatgggtccgagaccatacgtacaaactcaacacaatgcaattcagcgagacacttgaagtgttggagcagatgtttgagcagcacaagctggacaaccgtgacatccaagatttccgccaaaccgtggatgagtgcatcgccagacaggccgaagtgtcagcggaagactcctatgactactgtgaattgttgaagattctggagtctgaataccaacagttgcgtgaactctctgccggtcgaatggttgatttggactccctgattgcgttcatccgtgctgcccaactggaactggtttggattcacgaacgcgaagagttggaggtgacccgcaattggagcgatgtgcaacatttggacatcccaatgctgcaaaactatttcaaacagcttctgcatgaaattgagctgcacgagaagcaattcaacgatgttcacaaccaaggcgcagctctcatcaaccagcgccatccagccggcgaggtcatcgaggtgtacctgcgcacaatgcaaaaccaatgggattggctcctgaacttgagcaaatgcttggaaggccatcttcgggatgcctacaatgccaaggcattcctggaggaagccgaccaagtggagcagcaaatgcaccaacaattgaatcatcttgaccaaggctataatcgcaccgaattctcgctggatgatggcgaacgcatgcttcgtgagcttgactccatccgtgagcacatccaacaactccatgcccggcttctgtcactcaccgaacgctgctcccaaatctccccattgtggcaacgcggcgaacgcattggacggccgattgtgacggcattgtgtgaataccgcagcaaggagattcacatcagacaaggtgatgaatgcaccctgttggacaaccatgaccttcttcaatggcgtgtacgcggcatggacggcgttgaggcaaccgtgccatccgtcgtgttccgcatcccgccacctgatccacggcttgccaatctgctaagccgcttgcatggccaattcgaaaagttgcgcaaatcatgggaccgcaaacatcacttggtccgttacaacatggtgctgaacacaatgcgaacagtgggatgggatttggacacgtttttgtcaattccgccggaccagcgagatgaaattataaaggcgttgaatgaggatgtgaacaagctgctggcagagttggatcccaatgatccattggcacgccggttgaaggaggagttgcgcctaacgaacgaacatttctacgatttgttggcccgtgcccagcgtggcccagagcccgactattccaatgaatttgatcatgccgcggcagagttaatccggaaattcgaagaagcttggaagcagctcagcgaacgagcacaagtgcgcattcccggcaacatggatgagctggaacatcagataaaggagcacaaagtttttgaagacaatcttcaggcgcttgacgtggatgtgtccaatgtgaaagagttgtaccgccaattgcccaacccaacacccaaccaacgtgccaaacatgacttgatgatttcgcgctgggaggaaatctgggaactttgccgaatgtatgtggagcggctgaaggcactggagaatgtgctgaagagtgtggatgaagtgacggacattgtgcgccgtcatgaagtcaccctttcctcgtttgatgacatgccctcagcacttgaacgccttcgtggcgtccatgcccaactagttgagctgaacatggtgcttcaacagcagcgaagcattgtggagaatctgaacaaagacacggcccaaattcggtcgcatgtggcacgcactcgactgggcgtgcaacatcatcccgatgtggaccagctggaggagatcgtgaccagcttgacagtgcgctgggacaatgtgaacagtcaagtgacggatcggntcaggattgccgaagaggcgcaacaaacgcagatggtttacagatcgcaatacgatgaagaactccaatggcttgaccgtgtcgaggcaaccatcaacagtctgcgcagacccgaagagttgcgtccggaagagcttcaaggccaattagaccaattgacggcggaatacgcccagctccaggagcacactgccaccattgaaaacatcaacaaggaaggcggaaaattcattcgggatgcaaagggctatgacatcaaattggcccaataccatgacaacaccatcagcttccatggccaaagcatcaaggaggagttccgtcgccaagtgccgcagccaaagaatggagcgcaaattgtgacggaggagttggaggcgttaaaccgccgttttgcccaactctcctcagtgattctggagcgcaagaacatcgtgaatgtgctcattcagaattggcgcagaaaacagcaggctgcccagttgcacgagcaagtgccaatgcaacaggctgatgagtttgtggaagtgcgtgagatgccagaagtgccacacgtggccatctacgaagacgaaccccaaatgttccaagaagagactgtgactaaaactcagttctacgagatggaaggcattctgcacaaacagactggcgagattctcacgtttgttgaggccattcgccagggtctgcttgacttgagcagaggaggcgaattctttgacattgttagcggttcacgtgtttcgcttgacaaagctgtggaaatgggccttatcagcgagaacatcaccgaaacactgaacagtcgacatggaatccgccatccggagaccggcgaagaggtgactttgatggaggccatccaaattggtctctacgatcctgactcacgtcaattgcgtgacatcaaaacgggcgatctgctttcattgtacgattcacgacacatttgcccaacggatgtgcagcatcggctcatcaaaatgggcgtgctgaagttgccacccatggagttggagcaagcattgaagaatggagtgctaaacccacagactggccaattccgtggcaaatacgtgcaagacccaatcccattgagggatgccctcatcaatggctacatccaattcccgagtggacagcctctgttggcattgactctgtcggattgcattggggacggatacattgacgcccactctggagagtttgtcgatcgtcatggctcttctggcgaaaaattcacgctacgcgacgccctcgaccgccaacgtcctttggtgcgcgacaatgtgcgcgaatgtgtgaacactgccatcaaccaacgcatcacagtagccgatgctcttgtagcgcatgcactgaatccacggagtggaaagttcacggacttgcaaagtcgtgccgagctcagtcttcgacaggcccatgactttgggctcattcaaaagccattgacactcaccgaggttcttgaaaagggccaatacgattccagtggtcatttcctcgaccgtggcaatcgcttcaccttactggaggccatcaacgccggccttctggatccagaagtgcgtcacattgtgtccgagcaagaccaagaagtgctttccattgctgatgccctggaacggggacttctctcaccggatggccgaattgtacttgaatggggtccaaatggacaacaggaaaagcagatggatttgtacgatgctcaacgccaagggctgctgacacgccgtgtaagacacacaatctttgatgtaaagggcatccggaacacggagaacaacgcaaatttgagtttcaatgaggcagccgaagccggcatacttcaagtttctgctgaacgtgtgcttgaccaacaactgcagcaaaccttcatgctcagcgatgccgttcaaaaaggtctcatggattccgcactggcagacattctgtccacgccaagcggactttccgactctggtggcgaagtctcattgatccgtgccgttgcaaaaggccttgtggatgccaccaagggcgttatcctcgaccgccgctcccaacgcgaattgaccgtgcgtgaagcttacgaccgtgggctgttcacttctctgcgtgccgcaatgcgcttggccgccctgtttgatgtgcacccactgttgatgacacccgtgaaaaagaagccacacaaagctaggcgaatccaacgaccgggccaaccattggccggcgatcaagtgaaagtgacattggccgaggcaatgcgccaaggcttgatcgatgcgcgaacccagcgcttccgacaaggaaaccaggaaatgtcgctagatgatgcacttcaccagggcctgattgatccacacagcgaatggattgtgccctcaagggcatccggtgttgggccaaccattgaggagcgcacgcaagaaacagtgacggaaactggccagcaattggcaccaaaagtttatccggacaaagagcttcaagagacagtgaacaccgtgaagcgcgttaaacgcacggaaactagtgcggtcggcggcccaggcggtgtcagcgtgtaccgcgcagtgacgggtggcaaaggctccattgaagtgccggccaatggctatcatgtgttggaagcggagaggaaaggcattcttgacttgggtcgtggcgttgtccatcctcccggcaccgacaaatcattgagtctggaagaagcattcaatctgggcatcctcgatccacgctcagtcagcatccgtgacccgcaatcaagccgaaatctttccgtggatgaagcgctccaaaagaaggtgctcgacaggcacggcttcgtccaacatcatggacgccgaatgaatctgcaagaagccatcgatgagcgattggcgcacattgagccagagccaccggcaacgctgagtcaagcaaacaaaaaagtcattcaattttcgtcggctgccgggccggctgttgcattccgcccagttggaaagccggttgtggaagaacacgaacaagcctgggcttttgattccaaccagggggtcttcattgatgcggccaccaatgagcacatcccgttggattcggccatccgatcgggtcgtctctcggccgatgatctccgagcacgtgatgcactcacaggacgtgactattccctgtcggaagccgagaaatggggaattgtgaacatccgagagggctactatttggacaagactgacaacaaacgctactcatttgccgaggccgcacgtcagcatcggatttaccccacgggtggagtgcctgaaaatgcagccgatgcattgcacacgacagtgcgtgtccatacacgctcagaagttgccctgaaagaggcagtgcccagttccggccaaggcggtcatggcccagtggaatataaccttcatcgttatgtgcagcatcaacaattcgacccatcaactggccttttctcgcatcccgacgtgcagaagcaaatgacactgaaggagttgatcatcaaaggcttgctgaacccatacagcacacgcattgtagacaaagcgaatggaacagagctacggctactcgatgccatccaagagcacattgttgatgatgtggccggaacggtgcgagacacgcaaaccggacgagtccatgactttgcgtcggctgttcggcaagggcttgtcaaggaagacccattggccatcgagtcggtttttgaggatcggcgaaccagccgcacatctgtggggggcggtggttcgccaagacttgtggagcgcaagcttcaattgaccccgtacgcgcaggaacccttccgagggtcctctccatcgggcggtttcggcgccagtggaggaagtggaagtctgggagcccgcgaaggaggcggcacctcatcatggtctccaacaggcccaacacaaccaaaacaacatcgaggcgaagaatccgttgttcgacgcgaattcacaagcagcagcacgggaggtgcatttggaggcccaacattcggtggagcggttccgggagctggcttcagcagcgcctttggaaaccaacaacaagcagtgacaccctatgggaatggaccatccacaaccgggccaaacgaacgaatggtggatttgggcggtggcaagacggtaaaagtgaatgtgatccgtggcgcggatggactagagaagggcgagtactttgatccggccagcaacatgaaattcaccatccaactccacggcgatccagtcacaacacagaccagcacgaaagtgcgatccacttcgcaagtccaatccgttgaattggagccgcacgcccaattcgttggcattgaccagatcaaggacatgcgcaacggccgagtgatgacattggccgacgcacaacgacttggccttgcccgtgtggaccgcaagggcaaacagagcaccaaggagtacagcgcattccgatcgaacattgagttggccgtcaacaagggcattctggatgcacgcggtgtcaagctgtccctggaggaagcaatccgacagcgacttttggacatacgcgaattgaagtacattcacccacgcactggagaagcaattgatctgagcagtgcagcaaaccaaggcctggtggatgtcacactcgcggaaacgctgcccagtggagtgcacaacccagctactggcgagaagatcagcgttcaacgcgccgtcgacctgggaattgtgaatggacggactggggaagtgcggcacccgttgacgggcgaaaagctcagctgggtggatttgaccagaaaagtttacaatgcaatcacacaaaatggcgtctacgatccgcgcaaaggctacgccgttcccgtcgcctcggcacttgccgaaggcctcattgacacccgtgctgttgcctatctgaatccgattacccaagagcgcatttccttggaagaagccaaccaacgtggagtcatcgactcacaaacctaccatgcattgacaacgccatgtctcacggaccatcggtcaagaaggaaactaaatttggtgcaggccgttgatgcaaagttgattgatccacgtgcaaaaaccgtccaaatttcggacaaaattgtgcctctccaaaaggcagtcgaggaaggcgcccttccccgcgaagttggcgaacagcttcgccgcgtcgacaaaatgacatttgcggaagctgttggcaaaggcctgattgatgtggcccaagacaagttcacagacccggagagtggcaaacaaatcagtattgctgaggccgttcaacagggactcattgacacgggcgcagtgaagacgggcaatgatgagcccggggagaacaccaatttggcgaggctgattcaatccgagcattttgatgagaagtcgggacgagttcaagacccacgctctggattggcattgccgttcggcacggccgtcaaccaaagaatggtggacccagactctttgctgcacgatttggaatcctcaaaaacaatgaccattcgggaagccatcaacatgggcttggttgattcacacggccgctacgttccatccaagggtgccgcccaatcggtgccattgaaggaggccgtccagcgtggccttgtggccctcattggctcaccaatgcaagccgcacaggctgtcagcgaagcattgaaacgacgtgatgcggagggctacaaattccggctggaaccgctggatgatacgactgtgcaacggttgagt

SEQ ID NO: 37 - DNA, 1479 bp, Pratylenchus zeae
gggtttaattacccaagtttgaggaaaagcagcaccaaatcgggtgtcagcatcccattggaaaggatggcgattgaacaaaacggaacacttggcgagcaggtggaggaaatcgctgccggacaccatctgactccggtcgacatgaccacggccacatccaaactccaattggaggcagcagaggttcggagcccagcgaataagccaaattggacatcctacttgcgttcccaattggtcccacaaaacgagtacaacttcattgtggcacttgaagcggccaaatcaaaagcggaacgcgatgaagtgctcaaccgggaccgggccaattccgccaaatgcataatcaatttggtcattgaagtggccaaggaccagttgattcgctacattctcactgtcttcgatgatttgcttcaggaggacaaatctcgtgttgaaattttccacgaattttcgcgtcgccagaagcgctccatttggtcatggttccagggaattttgacgcgtaatgatggattcatagttaatcagatgtcgacgatttttgcaaaacttgcatgctatggatccacccacatggagggccaagaattgcaaacatatttcaactttctcaagagtgaactgcgaaatccgaacaatgagtacatcaacacctccgtgcgctgtttgcaaatgatgctccgaagtgagccatatcgccgtgcttttgtggattgcgacggagtgcccacgatcatttcggcgctggatggacgcgcaaatttccagctgcaataccaactcatcttctgcctttggtgcttgtcatttgacagcgcaatcgctcaatatctccaaagcatgggagtcatccaaacactcggtgatattctctctgagtgctcaaaggagaaagttgttcgcatcattttgcacactttccggaatttgcttgagaaaattgacaaccgtgatcttgtgcgtgaatccgcactccaaatggtccaatgcaagacgctgaaaacactggaattgatggatgcgaagaaattcgacgatgaagatttgttggaagacattgaatttctgtccgaacgtttacatgcatctgtgcaagatttaagctcctttgatgaatattgcaccgaaattcgctcaggccggcttcaatggagtccggtgcacaaatccgagaaattctggcgcgaaaatgcccagcgctttaatgagaagaatttcgaattgataaagatgcttatcaaattgttggaatccagtggcgatcctttggtcctttgtgtggcagcacatgacattggcgagtatgtgcgccattatccacgcggcaaaacgattgttgaacaataccagggaaaacaagcggtgatgaaactgttgagtgccgaagatccaaacgtgcggtatcatgcgcttctagccatccaaaagctgatggtgcataactgggaataccttggcaaacaattggat

SEQ ID NO: 38 - DNA, 3186 bp, Pratylenchus zeae
  modified_base (1)..(885): a, c, t, g, unknown or other
  modified_base (1456)..(1980): a, c, t, g, unknown or other
  modified_base (2353)..(2529): a, c, t, g, unknown or other
  modified_base (2620)..(2655): a, c, t, g, unknown or other
  modified_base (2833)..(3186): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaattttttagcccctcgaacatgccgaaatatgccctcgttcacgcgtgtgccacaaatgttgctggttggattcgcctcatttgtgatggaaaatgtgccctcagtcacaatgtgtcttgatcagtgtacaaatcctccaccagagacgggccagaattttgtgtgcaaatccgtgatgtactactacaatgagcaagagtgcattttgaacgcggaatcgcgtcaatccaagccggatttgttcattccggaggaggatgactttgtggtagactacttcgacattaactgccgcctggagcccgaacaatgcacgggcggccgccaagccaaattggtacgcaccctgaactcggcactgcccgaaggcgagggagccatccacgtgttggaaaccgtgcaggccggagtgcaggaatgtgcccagaagtgtggggaacatgcgcccgacaagtgccgcgcattcaacttcgacaagtcctcgggcacgtgcaacctgctgtacttggacgggcgtggttcgttgaggcctgagaccaaggcacaagtgggattttttgaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagataaaacacagcgaacccttctcgggcgtcatctttgtcaagaacaaatacgacacctgtcgagcggagttcaactcggaacagagtgtcaccctggtgttaggactgcccgcaaactttggcatgaaacccatcagcttgcaccatccgggcccatcaaacaacacaaatcctgaccaatcctcatcggcagaagcggccgcggaattggcttcacaacagcaaagacgccgccatcgacgccaatcccaacgggactgcggtcttcaggacatggacaatggcacctacaaaaccgtggttgtcgttcagaccaacaatttgggcattcccggattggtcacttccatggatcagctttatgaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgacatcctggaactccgttgggaaatcatggccatggacgacgagctggacttcttcgtcaaggactgctacgccgagcccggcatcnnnnnnnnnnnnnnnnnnnnnnnnnnnnnnnnnnnnttaattttttccagttgcccaactccggcggttgcccagaagctgatcccgaacccgatcaaggtgctgagcagtgcggtcaaaattgcgcacctgcaagcgttccgctttgacagctcctccacggtacgcatcacctgccatttggagctgtgcaagggcgactgcaaatcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39 - DNA, 1748 bp, Pratylenchus zeae
gggtttaattacccaagtttgagattaagtaaaaattcatggaattactacaaaattacaaaggagattcatcatccgatgaaggcgatgagatggaagagggcaccagcagcagttttgttggcaaacattcgcagctggcagtcgccctgccttctgttaatttggctccgcaagtgattgctcaacgagatgtccaaactgttgctgtggttgacccaaagacaaaggaactttattacaaccccaaatacgaagagcttttccagccagagtctggtccaagcaatccattcaaaagcgaacatcaacgtgcccaaaagaacatgctaacgggctttgtcgaacccgcccatgtcaatcaattccattttgaacgcgccattcgctcgtatgacaccctgggctatgcagaaaatccatcggctgatgcgggcaatacctttattggcaacgtggcaaaagccgaagagacaggcggcaaatcgctttttgaatcgacaaaaactggcggacaaaagcggaagcgggttgtcaactacgatgcctccgatgtggatggctacaccgggccctgggctcgttatgaaaatgaacaaactgtggccaagccagatccagaattgcaaaaggaaatggacgaaataatccgaaagaagaaagcgaagagccgcattggacggaagctggccgtcgaggagttgcatttggccgaagagagcacaaagctgcacatcaaagacgataaagactatttgggacgttcattcatggaagctccaaagagtgttggcgtgaatctaaggcaagatcatgtgcccgagcgttgctatcctccaacaaaacaagcccacacttacaacagccacaccaagccagtcacggccattcgttggttcccccgcagtgcgcatatgttcctgtcttgttcaatggatgggaaggtgaaactttgggaagtctatgggaatcgcaaactgatacgcacctacactgggcataaagttcctgtcaaagacatttacttcaacaatgatggcacagagttcttgagtgccgcttatgacaattacatcaaattatgggataccgaaacaggacaagttaaatcacgctttacaattggagcccacagagcttatgtggtcaagttcaatcctgatgaggacaaacaaaatctattccttgctggaatgtcaaacaagaaaatcattcaatgggacacaagaagtggcgaaattgaacaggaatatgaccgtcaccttggtcccgtcaattccataacatttttcgacaaaaatcgaagatttgtttcgacttctgacgataaatcacttcgcatatgggaattcggaattcccgtagacacaaaaatcatccaacacgctggacttcattcaataccttccatgacaaaagcaccgaatgaaaaatggatagttggacagtccatggataatcggattgtgcttttccaaattgtcgatgacaaacttcgttttgcacgcaaaaaggcctttcgtgggcataacactgccggatatgcatgctatgcggatttctcgcctgatatgagcttcattgcatccggagacgctgacgggaaaataaccatgtgggattggcgaacacacaaaatcgtttccacttggaaggcgcatgacaatgtgtgcatctctgtcctatggcatcctcacgagaagagcagaatgatcagctgtggatgggacaattccatcaagatgtga

SEQ ID NO: 40 - DNA, 745 bp, Pratylenchus zeae
  modified_base (745)..(745): a, c, t, g, unknown or other
gggtttaattacccaagtttgagtttctttttgaatatcaaattccaaaatggttcactgggtttttggcgtcattggcatcttggctttgttgctggtccttttcaaagtgctcgccgcactctggcgcatcctctggccctatgtgcttggacggccaaaatcgttggaagcgctggctggtccaggcaattgggcactggtgacgggctgcactgatggcattgggcgtgcttatgctgccgagcttgcttcccgtggcatcagccttgtgcttgtttcgcgttcggcacaaaaactggccgaaatggaggccgaattccgtcggcgttttgccaagcccgacttcctgaccgtagcctttgacttctccgaaccttcagttgccgtttacaagcagcgattacttgccaagattcagcacttgccaattggcattcttgtaaacaatgttggcgccatgtacacctttccgcagcgtttccacgatgccaatggcggattcgagaagatggctgatgtgatgacgattaacatgcatccagtcacgcttctctccgcctttgtgcttgaccaaatgacaaaaaggggacaaggcgttatcgtgaacatctccagcatgattggctatcgaccatgcttctaccagaccatctacgctgcaacaaaggcttatgtgaattgcctatctcaatcacttcgcctggaatatgccaaccagaagggcattcacattcagacggtn

SEQ ID NO: 41 - DNA, 705 bp, Pratylenchus zeae
gggtttaattacccaagtttgagatcacacgttaaatttgcaattaaatcaagaaaatagtgaaaattgaaaatgttccgcaaccagtacgactcggacgttacggtcttcagtccacaaggacgcttgcatcaggttgactacgctgtggaggcaatgcgacagggcagcgcaaccgtggccatccagggcaaggatcatgccgttgtggtcgcactcatgcgggcacagaatgagctttcagcattccaagagaagatcttcagcgtggatgagcacctgggcctctccatgtccggactgctggcggatggccgcattttggcgcgtgaagtccaacgcgagtgtgctgctttccgtcacgagttcggcgctccaatctcaatccaggaagttcgctcaaaacttggacaaagacttcaaaagaacacgcaatactacggctcgcgtccattcggcgttggattgctgctcattggctacgacgatctcggaccacacgttctcaaggccgaaccgtcgggcatggtcaccgccgagtacgcggccgcaattggcgcacgttcgcagagtgcacgaacctacctggagaagcacatggacgcttggaaagacggagacctcgacacgattgtcaagcacgcgctgttggcattgaaggagacgctgcaagccgacagcaacaaactggaccagaacgtaagt

SEQ ID NO: 42 - DNA, 1191 bp, Pratylenchus zeae
gggtttaattacccaagtttgagacacattaaaataacatcttaaactcctcaaccacccatcttccaaccaatccaggagatgtttccaatttcccgaagaggtatcaaaggaaaggaaggctccgtttgtggtgtttccgggccagttgtcaaggctgaaaacatgttgggcgcagcaatgtatgaattagtccgggttgggcattacgagttgattggcgaaatcatccgaatcgaacgcgacactgccacaattcaggtctacgaggaaacggccggactggcaattggcgacccagtgttgcggaccggaaagccactctccgttgaacttggtcctggaatcattgggaacatcttcgatggaattcaacgacctctacatgatattgcgcaaataacaaagtcaatctacattccacgaggcataaacgtcagccccctcaatcggaccaaaaagtgggatttcgagccgaatcaacgactaaagaagggcgaccatgttgctggcggggatgttgtcggctttgtgcacgagtcaatgctggtcaagcacaagataatggtgccgccaactgaacaaggaacaatcaaatttgttgcacccaaaggccgatacacagtcaaggacacaatcatggaattggagtattcgggccaaatccacaagtatccaatgtaccacgtctggccagtgcgcacaccccggcccgtgcaagaaaaactggcaaccgaccatccactgctttgtggtcaacgcgttctggacgccctcttcccctgtgtgcagggagggacaacagcaattccaggagccttcggctgtgggaagaccgtcatttcccaatcgctctccaaattttccaactccgatgtgatcatctacgtgggctgcggcgagcgtggaaatgagatggccgaagtgttgcgcgatttcccccaactcaccatggaagtgggcagcaaaacaacgtccatcatggaacgcactgtgctggtcgcgaacacctccaacatgccggttgctgctcgcgaggcttccatctacaccggcatcacaatggccgagtatttccgcgatatgggcctgaacgtggcaatgatggcggattccacttctcgctgggccgaggcattgcgggagatctccggacgtcttggtgaaatgcccgcagacaatggctatccg

SEQ ID NO: 43 - DNA, 3724 bp, Pratylenchus zeae
  modified_base (1532)..(1576): a, c, t, g, unknown or other
  modified_base (3590)..(3595): a, c, t, g, unknown or other
  modified_base (3695)..(3724): a, c, t, g, unknown or other
gggtttaattacccaagtttgagtttgtagataaaaaagaaagcaattaatcaaaccaaaaattgaagcacacaaaatgctatttgacgacgacgacgacatgccgcgtgcatttgaggatgacgatgagccgcaagaacagccagaagactacgaagaatatgaacaagaggaggaggaacagggccaagagccgatggaatatgaggacgaagatgacgagatctcgactgaactctggcaagaagcctgctgggtggtcatctctgcgtatttcgacgagaagggcttggtgcgccagcagttggacagtttcgacgagttcattcaaatgatcgtgcagcgcattgtggaggactctccggcggtggaactccagaccgagctgcaacacgccactggtgaaatcgagtcgcccaccaagttctcgctcaagttcggtcaaatctacttgtccaagccaacccactgggagaaggacggcgccccaactccgctgatgccaaacgaggcgcgtctgcgcaacctgacctactcatcgcctctgtacgttgacatcaccaagaccatctcgaaggagggagaggaggatcaagtggccaactaccagaaggtgttcatcgggaagattccaatcatgcttcgctcgagctactgtgtcctttccaatctgactgaccgcgacttgaccgagctgaacgaatgcccgctggacccgggcggctacttcatcatcaacggcagtgagaaagtgctcatcgcgcaggagaaaatggccaccaacacagtctacgtgttctcaatgaaggacggcaagtacatgtacaagacggagtgccgttcctgcttggaacagtccagtcgtccatcttctactctttgggtgaacatgaccaaccgcggcggcggaaaggctgggaaaaatgctatgggccagaagatcatcgcaatcattccgtacatcaagcaggaaatcaacataatcatcgtgttccgcgccctcggcttcgtctccgaccgcgacattctcgagcacatcatctacgactttgacgaccaggaaatgatggagttggtgaagccactggacgaagcattcgtggtccaagagcagcaggtggcactgaacatgattggaactcgcggggcaaagccgggcgtgacgaaggaggcacgaatccgctatgcgcgcgaaattctgcagaaggagatgctgccccatgtgagcattgcggaacattgcgagacgaagaaggcgtatttcctcggctacatggtgcatcgcctgctgctggccgctctgggacgtcgtgagctggatgaccgcgatcacatgggaaacaagcgtctggatttggccggccctctgttggcttctctgttccgtgcactctttcggaatttgctcaaagaggtccgtctgactgcccaaaagtacatcaacaagaacggcgatttcaacctggacgtgtgtgttcgcccaacaatcatcactcgcggacttcagtactcgttggccactggcaattggnnnnnnnnnnnnnnnnnnnnnnnnnnnnnnnnnnnnnnnnnnnnngttctcaaccgtctcacctacacagccaccctctcccacttgcgccgttgcaattcgcccattggagaggggaagctggcaaagccgcgtcaactgcacaacacccaatggggaatggtttgccccgcggaaacgcccgaaggccaggccgttgggctggtgaagaatttggcactgatggcgtacatttccgttgggtcgcagcccgagccaatcctggagttcttggaggaatggagcatggaaaatttggaagaagtttccccgctggccattgcaaacaacacgaagatctttgtgaacggctcctgggtgggcatccatcgtgatccggaccagttgatgaccacactgctcaagctgcgtcgccaaatggacatcattgttagcgaggtcagcatggtccgagacatccgtgatcgggaaattcgcatcaacacggacgctggccgcgtgtgtcgcccattgctgattgtgaaggacggaaagctggcacttcgacgaagccacattgaacagttgaaggaacgcaaccccacagccgagcagcaataccaatggtccgacctggtggcgggcggcgttgtggaactgatcgacgccatggaggaggagaccctgatggtggccatgaccccggaggacatcaagagtggcggctactgcgacacctacacccattgcgagatccatccggccatgattcttggcgtttgcgcttccatcatcccgttcccagatcacaaccagagtccccgaaacacttatcagagcgccatggggaaacaggcaatgggcgtgtacaccaccaatttccacgtgcgtatggacacgctggcccacgtgctctactatccgcagaaaccgctggtcaccacccgttccatggaatacttgcgtttcaacgagctgccggccggcatcaatgccattgtggccatcctctcctacggcggctacaaccaagaggactcggtgatcatgaaccagtcgggcattgaccgtggcctgttccgctccgttttctaccgctcctaccgcgacaacgaggccaacattgacaacgtgaacgaggagctgattgagaagccgacgcgcgagaagtgcaaaggaatgcgccacgctctgtacgacaaactggacgaggacggcatcagctcaccgggcacgcgcgtttcgggcgacgacgtcatcatcgggaaaaccattgccattccggaaattgagaacgagttggaggccagcgccgcacgctaccagaagagagatgcgtccactttcttgcgcagcagtgagacgggcatcattgatcaggtcatgatcacgctgaactccgagggcaacaagttcgtcaaaatccgcgtccgctctatccggctgccccaaatcggcgacaaatttgcctcgcgccacggccagaaagggcacaatggggggatgatgtaccgcgaggaggatatgccgttcacgcgtgaggggatcaccccggacatcatcatcaacccgcacgcggtgcccagccggatgaccattggccacttgattgagtgtttgcagggaaagctgtccgccaacaagggcgaaatcggcgatgccacccccttcaacgacaccgtgaacgtgcagaagatcaggcaaaccctgttggccgagtacaactaccacctgcgcggcaacgagatcatgtacaacgggttcaccgggcagaagttgacaactcaggtattcattggtccgacctactaccagcgcaaacacatggtggacgacaaaattcattctcgcgcgcgcggaccaattcaaggcatgaatcggcaaccgatggagggaagagctcgcgacggcggcctgcgcttcggcgagatggaacgcgactgccaaatctcgcacgggtgtgcccagttcctgcgcgagcgtctgttcgaagtgtccgacccgtacctggtctacgtgtgcaaccagtgtgggctcatcgtcatcgccaaccagcgcacgaacacatttgagtgcaagnnnnnngacaaaacccaggtgtccgcagtgcgcatcccctacgcttgcaaactgctcttccaggagctgatgtccatgtcgattgcgccgcgcatgatggtgaagnnnnnnnnnnnnnnnnnnnnnnnnnnnnnn

SEQ ID NO: 44 - DNA, 1914 bp, Pratylenchus zeae
  modified_base (1411)..(1422): a, c, t, g, unknown or other
gtcttcgagtgcaatccccaggagactgccacttttgtgcgcatctcccgggctcggctggacggcaccccgttggtggtgtccacggctggccacgacctgacctgctcccagtactgccgcaacaacattgagccaaccacgggcgcccagcgactctgcgcctccttcaactttgatggccgcgagacttgctacttcttcgatgatgcggctgccccagcggcgggcacagccgaactgaacccgaatccgtcggcgaacaacttctactacgagaagacctgcctgccagcggtgaatgcccacgaggcgtgctcctaccgctccttctcctttgagcgcatccgaaagactgccctcgagggttttgtgaagaaaagcatccaggtggccaaccgcgagcaatgcctgagtgcgtgtctgaaggagcgcgagttcgtgtgccgttccgtcaactacaactacgacacgtacgcttgcgagatgagcaccgaggacaggcggtccaagcccacgaatctgcgcatgactgaccagcccattgactacttcgacaacaattgcctcaaccgccaaaaccgttgcggcctgcagggaggcaacttggttttcgtgaagaccacccagttcgagatcaaatactacgaccacacacagtcggtggagccgcaggagtcgaattgtctgcagaagtgtctggactcgctgaacactttctgccgttccgtggaattctcgccgcacgagaagaattgcattgtcagcgatgaggacaccttctcgcgtgccgaccaacaggcggcggtccagagcaaggactactacgagccgatttgcgtttccgccgatttgtcttcctccacgtgccgtcagcaagcggcattcaaccgcttcattggcgtctccattgaaggccaaccggtggccactgcccagggcgtcaccgtgtccgactgcatctcgctgtgcttccaaaacctgaactgcaagtccatcaactatgaccgcacccaaagcacctgctacatcttcgctattggccaggcgaatgccaacgtgaagaagaacccatcagtggacttttatgaattcaattgcgaatcccaattcggcggaatggccctttgcaccaacgatggcattcgcttcattgtgaacaccaaagagccctacacgggtgccatttatgcagccgagaagttcagcacgtgctcgcaagtggtggaaaatgccaagcaaatttccatcactttcccgccgccgaatgtgtcgcccaactgcggcaccacaatcaaagatggcaagctggaagcgttggtggttgtgtcgctggacggggtgatgccccaccaagtcacaaccgagtgggaccgcttctaccgagtttcttgcgacgtgaacatggacnnnnnnnnnnnngagggcaccgttgttgtcaccacaatcttcgagacaaaggaagcggagccccaagtgcttgatgctggcactccaccacccataactgctgccctctccttcctggatgccgaagagcaaccactgcagaaagcatccatcggtgatccgatcaaattggtggtgcacagtgagcaggccggtccgcacaacatgatgctgacggagtgcacggcaactcgggtgggcggtgaaggcgaggccgtgccattcacaatcattgacaacggatgcccacgctatcctgcccttgttggccccgtggagccggactttgacaagaaccgtttgcgggcggacatgaaggcgttccgactggacggctcctatgacgtgcagatccagtgcacaattatgttctgcgcaggcccgaacggatgtccaccgagcaattgcttggattccggcacaaacgatcttttcttgtcccatggtcgacgaaaacgacacgca

SEQ ID NO: 45 - DNA, 1911 bp, Pratylenchus zeae
gggtttaattacccaagtttgagcaactcaaataaattatttcaacaaattccattcaacaaaatggcttcctccgacgttgcccaactccaagatgcggccaaccgtatgcgtgtgtcctcaattgagcaaacttgcaagtcgaattccggacatccgacaagcagttgcagtgctgccgagatcatggccacgctgttcttttccgagatgaaatacgatgtgcagaatccgcgccatccagccgctgatcgtttcattctttcgaagggccatgcctgcccaatcctctacgcggcctgggaggaagctggtttgctcagcaaagagcaagtgctcagtcttcgccgcattgactcggacattgagggacatcccacgcctcgactgaacttcattgatgttgcgacaggttcccttggacaaggcctttcttgtgcggccggtatggcctacgctggcaaatatgtggacaaggcttcctatcgtgtctattgcctgcttggagatggcgaaagtgcggagggatccgtttgggaggcagcaatgttctcgagctactacaaactggacaacctggtggccgttgttgacgtgaaccgtctgggccaaagccagcaaaccatgctggaacatgatgtccagacctatgccaaccgctttgctgcttttggattccattccattgttgtggatggacatgacgtgaacgcgctgctgaaagcttatgccgaagcaaggaatgtcaaagggaagcccaccgcaatcattgcaaagacattcaagggcaagggcattgagggtgccgagaatgaggacaattgccacgggaagccggtgaccatggataaggcggacaagattcgtgccctgttgaagagccaaaccccagtgaaatggaacattccaaagccggctggggacgcacaaaatgtggatcttggcattggccgcatcaagatgagctccccaccgcaatacaaagttggtgagaaagtcgcaacccgtcaggcttatggtgatgccttgctcaaattggcggatgtgaacaagcgagtcattgctttggatggtgacatttccaactcgacattctcgaacaaagtgctcaagaagtacccggaacaattcgtacaatgcttcatcgccgaacagaacatggtgggcgttggcgtcggcatggcctgtcgaggacgtgccattccacatattaggcacttttgccgcttcttcacccgtgccggcgaccaaattcgcatggctgctgtttcgttcgccaatgccaaattcactggttcccatgttggcgtgtcaattggagaggatggtccgagtcaaatgggcttggaagacttggctctgttccgtgccctgcccgacagcctggtgctctacccatcggacgcggtctcagcggaatacgccacggaattggcgtcaactaatggcataacctacactcgcgtcagtcgtcccaacacgcccgtcatctatgccaacaacgagaagttcgaggtgggcaagtgcaaagtgcttcgacagtctgctgccgacaaagtgctgctgatcggtgccggtgtgaccctctatgagtgcatcaaggcccatgacatgttgagctcggcgggtaccaacgtggctgtgattgacctgttctccgttaagccaatcgacgtggaaaccctgtcgaaggaggcgcaacgcgttggtggaaaagttctgaccgtggaggaccactatcaagccggaggaattggtgaggcggtagccatggctttggctgatctgccgaatgttcgtgtccgtagtctcttcgtcaaagaattgccgcgctcgggcaaacccgaagaacttgtggagcactacgggatttccgccaagagcattgtggaggcggtgaagaactactga

SEQ ID NO: 46 - DNA, 1119 bp, Pratylenchus zeae
tcagcccaaatcgaggtgataccatgcaaagtttgcggcgacaagtcgtctggggttcactacggtgttatcacatgcgaaggatgcaagggatttttccgacgttcccagcagggcccaaccaactaccaatgtgcgcggcaacggaattgcgtcgttgaccgcgtcagccgcaaccgttgccaatactgtcggctgaagaagtgcatggaacttgggatgagcagggaagccgtcaaatttggacgcatgagcaaaaagcaacgcgagaaggtcgaggatgaggtccgtcttcacaaacaacgcagcggtgaattcgcccccaactcgtccatttccacaccaccggttatgtccgcctcaaatggcacccatggccaatatcagcaggcccactttgtgtccgctccaaactcggttggcccatcaaccccaggcagtgcaggcattgacttcaaggaattcaaatattccccaccaaatggcccaattttggttggcacctacggacagccgccgcaactcttccacccggcagctgccgcccaacaattccatggcagtccgggcgatgaacaattccatttgcccttgggcggcagccaaatggcaaacgttggtttcgggcagcccagctgttcctcaacctcactgctctacgcccatcaacaattgccccacgcgtgcgctccaatctcatactcattgccttccggattcggccaacagcagcagcccgttgcccaattgggtgttgtgccttccagcagtggaggatatcccgtgcccgagtcggtgtgccaagtccagcacgttgtctcctcaactgtggacgatgagctcatcaagagtgtcagccgtgcctacgaattgacatacgtgcactacttgcccaggcgatgggaccaacaattggaattggacgcacaacaagtggaacgactcagaaacatgaatcgaaccgatggatggctgaaattcgccaaggagttgaccgaaataatccggtgcatcattgagtttgccaaggccatcaagggcttccaagagttgaaacaggatgaccagatccaggcactgaagcagacaacctttgtgctctccctgattgccattgcg

SEQ ID NO: 47 - DNA, 1568 bp, Pratylenchus zeae
gggtttaattacccaagtttgaggccaaaatcaacagatttacaagaactagaagtatgatgatgatgggcaacaacgattggtcctcacgtgcttctcaatctcaacagcagcaacaacaacaacaacaacaaccagtcgaaaccacagccattccccaatacggtgtttcaccgccaatctgtataaagccaccaacagagcgcgatttgcgcttgacacgcgagcttgacgagtacatgcagaaatgtggactctttgagagcaccgcagacatgcaaaggcgactcgaggttttgcgccgaatcaatgccatggtgaagaaatgggtgaaggaggtttcacaggagaaggttccacccgaccagttggagaccgtcggtggcaagctgttcacatttggctcttaccgacttggtgttcatacccccggtgctgacattgattcgctgtgcgtggttccgcgacacattgatcgcaccgatttcttcgcttcattttatgaaaaactcaaagaggatgaaaacacaacggatttgcacaaagtggaggatgcattcgttccggtgatcaagttgcgctacagcggcatcgatctggacattcttttcgcgcggttggcactcaaggaggtggccgatgatcagcagttgacggacgacaatttgttgcgcaatttggacgagaaaagcattcgctcattgaatggttgccgagttgctgacgaaattcttcgactaattcccaaccatcggaatttcatcgttacccttcgcgcagtcaaactttgggccaaaaatcatggcatttactcgaatgtcctcggctttctgggcggcgtcgcatgggcaatcctggtggcgagaacctgtcaactgtatccaaatgcagcacccgctgtactgcttgagaagttcttcctggtgttctcccaatgggaatggccgcatccggtaattctgaaagatgcggacgcaacgccgcgcgttgatatgccctactttgtggacatgatctgggatccgcgcacccgtgtttccgaccgctaccacctaatgcccatcattacaccggcattccctgaacaaaattccactttcaatgtgaccaagtcgacacgtcaagtgatgacaaacgagttcaaagaaggcctgaacacaatgatcgaaatcacaaaaggcgaggccggttgggacaaactcttcgaggagatcaacttcttcacgcgctacaaacacttcattgccctgctctgtgtgacggccgatgaagaggaccatctcattttcagtggattggtcgagtccaaaattcgccatttggtcgcttccctggagcgcaacccgtgcgtggcgttgtgccatgtcaatccaaggcagtacaaaccaatcgacaccaaggatctcgagattgaatatgaaaatcccgtctgcaccctttggttcattgggctcgagttcatgagggacttgcaacgaagcatgaacatcaacctgaccgaggagattcaggcgtttgtgtccaacacggtctacttgagcgcgtccgcaatgaaggacttcaagccg

SEQ ID NO: 48 - DNA, 1088 bp, Pratylenchus zeae
gggtttaattacccaagtttgagagtctaaaaatggcatgcaacaatttgaagctggccattgtacgtgccgaatcccatcttctcggcaatcggcgcaaattctcatcagcacttgcggcaacaacgccctgcattaaactcaaccgcgcatcatgtttgtcaccccaaaaggcacaacaacgccgaacaattgtggacagaaaaacgctggcccggctattgcctgacaactaccccgacccatggccgtacaaagagagaagctttaccttcaacaacattttcttcaactccaccatgacgcggttgcacagaaattcccggatcattgtggttgaggggaacattggaagtggaaagagtgaatttgcggcccaactggcccaagagcttggcttctaccacatgcccgccttttccatgaacgaaattctggtcgatcggtacgggaatgatttgcgcaaattctatcatttgttcccaaagcgctatcgcacacccgatgagctgatgttctacgccaacccaacggacgacaacaccgccgtcatgcaggacaccatctaccagtgtcgctttgatcagcacatgaacgcgttggcgcacatttttaacacgggccaaggcgtggtgatggagcgctccgtgttcagcgactttgtgtttgtgaacgccatgtacgagaagggatggatcagtccggaatacttcaaatattaccatttcgcacggaaagtgacccttcccaagttggacttgcatccacatctgtacatctacctgaacgcgcccatctcgaagtgcttggagaacatcaaaaagcggggaaatgccaatgaaattgagcacgttgatgccagatacctgaaaaccatcgaggagtcctacaaggactttctgcgcgaagtgaaactcgggtcctatgtgctctcctacgactgggcccagcccgagtacatggacatcgtgttggaggacatcttcaacctgaacatggacacctacgagtggcacaccatgagtgatgtgttgcagccgtggcacagcattggcgaggccgacttcaactatgggtggcacagatgg

SEQ ID NO: 49 - DNA, 1224 bp, Pratylenchus zeae
gggtttaattacccaagtttgagagcaaaaggcacattccatggtttccacttcgagacgcatgaagcttgtttccattccgacaatatttttattcattacaattacaacagttgtcagaggccctagagtttttgaagacgctttgacgacgcacgactgtaaaaaatttccaatcgtcgcaacttcttcgggatgtgtggattacacagcaaaaccatttaaagttgaagcaaaggacccgaagaatccctgcttgctctacatggagtcaatctcggtggtgctatacaacgtgaaaaccaagcaatcggcatgggtcgtcctgaatgactcgtacagtgtcgcaattaaatgcccagccagcaacaacattggcgcggaattcagtgttgatttgtcagcagacgcccgggatgtgcctggctacaaaattgatgagaagaacagggtaaaggaaaactctgtgttcactgttaatggttttcatattggattaaccttcaacttcacacaatccgcttattggcaattggttgatgcaaaagctgatcaaattaagggcgataaaatgccgaacatcgatggaaactcaaaaattgtgaccggacttccgagcgccggcaaatccgcattcctgttcaaggacagccacgcgccggattggaacattgccggtttcaaggattatgggtttgcctgtgcgcacacaaaaccaattgtttgggccaacgaaggagacgccaattatgcggttggggttgtcttcaacaacatgcagatgtctctgaatgcaacctacgttgatcaagaaagcaaagcgccattgctgcgattcagtcccaaagtcagcgactgcgcccctctgttcagcattggcacttggatggggctgattgttgcgctgctgctcattggggtgctctccttcggcttcctcatgctcaactccgtccagacgatggaccgcttcgatgaccccaagcagaaacaattggttatcaacgccaaggaatgatcaggaatgaaaattagtgcttgattcgatcattttccacacatgacgatccatcccattcccatctgcagttccaagtcgagtcgcttccttcgaattactttatatgtatttccattttctttagaaaatacaattcattttattcaaacagatttttaccgattaaactagttaaattaaaaaaaaaaaaaaaaaaaaaaaaa

SEQ ID NO: 50 - DNA, 474 bp, Pratylenchus zeae
atgattcattacatgttgcttttctccagacaaggaaaattgcgcttgcaaaaatggtatatggcctatccagacaaggcaaagaagaaaatcacgcgtgagctgatcaccacaatattggggagaaaaccaaaaatgtgcgcctttctggaatataaagagttgaaagttgtgtataaaagatatgcttcactctacttttgctgtgcaattgaacagtcggacaatgagttgctttgtctggaaattattcatcgatatgttgaattgttggaccgatattttggcagtgtttgcgaattagacatcatcttcaattttgagaaggcctatttcattttggacgagtttcttctggctggcgaaatacaagaaacgagcaaaaagcaagtattgaaggccatcagcgcacaggaccttattatggatgaggaaaccacccagggctttttcgaagacaatggtctcggttga

SEQ ID NO: 51 - DNA, 1443 bp, Pratylenchus zeae
gtttcacaccgtgaagaggattcaatgaatcaagaaccgtctatgagtgggcagcaaatagttggtctgatcattccacctcctgacatccgaacaattgtcgacaagaccgcgctttttgtcgcccgaaatggggccgaatttgagaacaaaatccgtgaacgtgaagcatccaatatgcgtttcaatttcctcaacccactggacccttatcatgcttactacaagaacaaagtcaaagaatacgagacgggcgttgcttcagcaaaattacccgaagctgtccgtgaacacattcaaaaagctgagttcataccacggaatccgcctaaaccgttcgaattttctgccgatccttcaacaatcaatgcatttgatttggacctcatccatttgacggcactttttgtggcaaggaatggccgccaattcctgacgcaattgatgaatcgcgaagtgcgcaacttccaatttgactttctgaagccacaacattcaaatttccaatattttaccaaattggtcgagcaatacacaaaagtaattattccgccaaagaatgttgttgatgagttgcgaaacactggcagccaccaaaagatcctggaagatatccgctaccgagttggatgggagaaacatcaaaaagccatcaaggatcgtgaggacgccgaagttgagcaggagcggatggcgtacaaccaaattgattggcacgactttgttgtcgtccaaactgtggactttcagccaactgaaaccgtgaatttaccgcctctttgcacaccaaaggatgttggggcacggattttgttgcaacaacgcacggaggcggcaaaagcagctgcagagagtgtggcgatggacatggaatcggaatccgaggaagagccagaggaggaaggacaagctgaggacttgcagcatcgtctcaaaatttccgaaaagcagcacactggttcagctgttacgcaacctgcaccggctgccccaacagctagcaatgttgtgatccgtgattatgatccgaagaaagctcgtgccggtacccagtcaaagtcggcagagaaattcatcatttccccattgacaaatgagcgtgttcctgcggacaaattacacgagcatgttcgttacaatacagtggatccacaattcaaggaacagagagatcgtgaacaaatcgaacgccatgatgaagatcccatcacggcctcaggaaccgaaattagccgcaacattgcaaaactggctgaacgccgtactgatatctttggcattggagagaagggcgccgaacaaaccataattggcaagaagttgggcgaggaggagcgcacaatgccccgttcggatccaaaaacgatttgggacggccaacaggcaacaattgacgccaccactcgggctgcccagcaatcagtcagcttggagcagcaaatc

SEQ ID NO: 52 - protein, 784 aa, Pratylenchus scribneri
MAVKMGMDAVMENGDESMNSLQGMSENQEPIVNGVNELNGDGEHQNGSNMTNHTAMSNGDSNQPQDDPDNIPWAQRIRDKQQDKGNDEVPDDNIPWAQRMRKNKADNGLDQSSTAMEVESTETTRSSKGTETTRSSKRISTTATTSSTSQKSRKSKAAESSDEEEEYKPEKKKSKKETSSTKKVKKEVKYEEEEEEDEAPTSSHKKKKTTKVEVKEEGPVKKRKKVVEEEEVWKWWEEEQVTEKDLTVKWTKLEHKGPMFAPEYVPIPNTVKFKYDGKPIQLSKDAEEVASFYAKMLDHDYTSKPVFNKNFFKDWRRVMKPEEREKITDLKKCDFSEMHAHFLSETEKRKARNKEEKKAEKEVKDQEAKEYGYASLDGYKQKIGNFRIEPPGLFRGRGEHPKMGCLKKRVRPEDVVINCSPGGKIPPPKGHKWKEIRHDNTVTWLCSWTENVLGSNKYIMLNPSSKLKGQKDWEKFEKARKLKGLVGPIRDQYIIDFKSKEMRIRQRAVALYFIDKLALRAGNEKDTEEAADTVGCCSLRCEHIKLHDEMDGQKYVVEFDFLGKDSIRYYNRVPVEKAVFKNLKIFMESKEPGDDLFDRLDTSSLNIYLKELMDGLTAKVFRTYNASITLQEQLDKLTNPDDSVHEKLLSYNRANRQVAILCNHQRAIPKTHEKSMENLENKIKEKKKEYKEIKAELKKKKSDEKLQKKYMRVKEQLEKLKTQRTDKDENKQIALGTSKLNYLDPRITVAWCKKYEVPIEKIFSKTHRDKFRWAIDMTKEDFIF

SEQ ID NO: 53 - protein, 375 aa, Pratylenchus scribneri
MSAQSAEEAQLASCQAYVRQHNIQQLVKDAIVSLCIHKPDNPVLFLRDHFDRIAAEQQRQQFSQETVHNVPDEDDTLEEPPRLPQGNRRRLGVSAEVPDENEAANYQRVVIPKDEDTQKALRQAMCKNVLFAHLDLDEQKAIFDAMFPVEKPKGETIIEQGEEGDNFYVIDNGEVDVFVNGEFVLSIKEGGSFGELALIYGTPRAATVVAKSDLVKLWAIDRLTYRAILMGSTMRKRKMYDEFLSKVSILSDLDKWERANVADALEQCQFQAGTHIVEQGQPGDEFFIIVDGEADVLQRPNDDAPFEVVGKLGPSEYFGEIALLLDRPRAATVVAKTPLKCVKLDRARFERVMGPVREILKRDVGHYNSYVKLMT

SEQ ID NO: 54 - protein, 451 aa, Pratylenchus scribneri
MSTAVSPSISVEDWKSELKLPQKDLRYKTADVTATKGIEFEEFGLSRDLLKGIFEKGWEHPSPIQEASIAIALSGQDILARAKNGTGKTGAYCIPCIEKIDPTKEYIQAMIIVPTRELALQTSQICVELSKHLKIKIMVTTGGTDLRDDILRLNGIVHLVVATPGRILDLMEKGVANVSQCKTIVLDEADKLPSQDFQGVLDRLVNFLPGDRQIMLYSATFPKTVALFMSKHMQRPYEINLMEELTLIGITQFYAYVQEKQKVHCLNTLFRKLQINQSIIFCNSTQRVELLAKKITELGYSCYYIHSKMAQHHRNRVFHEFRQGHCRNLVCSDLLTRGIDIQAVNVVINFDFPRNSETYLHRIGRSGRFGHLGIAINLITYDDRYNLRRIEKELKTHIDPIPKEVDPKLYVAEHQMDHEEFDQVEAADMNNHHSAAESNSDEQQQPQMMSG

SEQ ID NO: 55 - protein, 736 aa, Pratylenchus brachyurus
MVEAQQSIMSLQNGGSISMDSSIVQKNEPIENGINSTSSSGEHQNGNTPHEDLDNTPWAQRIRNKRESKTTDQSYEENEVSETRISKKSKPNSNKVEVEKHVKKRKSKVSESSEDEYSPEKKKAKRDAAKSSKKTTKKEVVKQEEETPTSTHKKKKTKIEIVEASSSSGSPTKKRKKIEEEEEIWKWWEEQSPEQSDGTVKWKTLDHKGPLFAPEYVPVPKSVHFKYDGKTMELSNQTEEVASFYAKMLDHDYTSKPIFNKNFFKDWRKIMTPAEKEKITDLRKCDFSEMHAYFLAESEKRKARSKEEKKAEKEMKEKEAKEYGFALLDGYKQKIGNFRIEPPGLFRGRGEHPKMGCLKRKVQPEDIIINCSKGVHIPPPKGHKWKEIRQDNMVTWLCSWTENVLGSNKYIMLNPSSKLKGQKDWEKFEKARKLKAYVGPIREQYLTDFKSKEMRIRQRAVALYFIDKLALRAGNEKDTEEAADTVGCCSLRCEHIKLHEEMDGQKYVVEFDFLGKDSIRYYNRVPVEKPVFKNLKLFMEGKEPGDDLFDRLDTSSLNTYLKELMDGLTAKVFRTYNASITLQEQLDKLTNAEDSIHEKLLSYNRANRQVAILCNHQRAIPKSHEKSMETLENKIKEKKKEYKEVKAELKAKKGDEKLEKKYHRVKEQLEKLKTQRTDKDENKQIALGTSKLNYLDPRISVAWCKKYDVPIEKIFSKTQRDKFRWAIDMAKEDFIF

SEQ ID NO: 56 - protein, 373 aa, Pratylenchus brachyurus
MSAGGQSAEEAQLASCQAYVRQHNIQQLVKDAIVSLCIHKPDNPVLFLRDHFDRLAAEQQRRQFSQETVHNVPDEDDTLEEPPRLPQGNRRRLGVSAEVPDENEAANYQRVVIPKDEDTQKALRQAMCKNVLFAHLDLDEQKAIFDAMFPVEKQKGETIIEQGEEGDNFYVIDSGEVDVFVNGEYVLSIKEGGSFGELALIYGTPRAATVVAKSELVKLWAIDRLTYRAILMGSTMRKRKMYDEFLSKVSILSDLDKWERRRAGTCQFEAGTHIVEQGQPGDEFFIIVDGEAEVLQRPNDEAPFEVVGKLGPSEYFGEIALLLDRPRAATVVAKTPLKCVKLDRNRFERVMGPVREILKRDVSHYNSYVKLMT

SEQ ID NO: 57 - protein, 444 aa, Pratylenchus brachyurus
MSTAISPSMSVEDWKAELTLPQKDLRYKTADVTATKGLEFEQFGLSRDLLKGIFEKGWEGPSPIQEASIAIALSGQDILARAKNGTGKTGAYCIPCIEKIDSSKEHIQAMVIVPTRELALQTSQICVELSKHLKIKVMVTTGGTDLRDDILRLNGVVHLVVATPGRILDLIEKGVANVAQCKTVVLDEADKLLSQDFQGVLDRLVNFLPNDRQIMLYSATFPKTVATFMNMHMQRPYEINLMEELTLLGITQFYAYVQEKQKVHCLNTLFRKLQINQSIIFCNSTQRVELLAKKITELGYSCYYIHSKMAQHHRNRVFHEFRQGHCRNLVCSDLLTRGIDIQAVNVVINFDFPRNSETYLHRIGRSGRFGHLGIAINLITYDDRYNLRRIEKELKTHIDPIPKEVDPKLYVAEHQMDLEAFDHPEMNNHHHSDESVNDGHQGSG

SEQ ID NO: 58 - protein, 766 aa, Pratylenchus zeae
MEMETDSVNMNDNLQNGCHDHGGEDLNTSGEISSLGQSLENGVDSGQSNGGHQNGDNSAEKETPSTDEAKDKEDLDNIPWSQRIRNNKKKSENGVAHLNNTISVSEETIETRTPKRTKTGTAVQVEKRRKTRKESESSVEEYKPEKKKSKGSTKASSSSVETVKTEIKEEEKSPDGVTHKKKKTIKIEVKDEPSSSGSPTKKRKKVEEEEEVWKWWEEQEQAPEKSDGTIKWSTLEHKGPMFAPEYVPIPKTVKFKYDGKPMELSTAAEEVASFYAKMLEHDYTSKPIFNKNFFKDWRKVMTHSEKEKITDLKKCDFTELHAHFVAESEKRKARSKEEKKEEKEAKDKEAKEYGFATLDGYKQKIGNFRIEPPGLFRGRGEHPKMGCLKKRIQPEDVVINCSKGVHIPPPKGHKWKEIRHDNTVTWLCSWTENVLGSNKCIMLNPSSKLKGQKDWEKFEKARKLKGFVGPIRDQYLTDFKSKEMRIRQRAVALYFIDKLALRAGNEKDTEEAADTVGCCSLRCEHIKLHDEMDDQKYVVEFDFLGKDSIRYYNRVPVEKAVYKNLKIFMEGKEPSDDLFDRLDTSSLNAYLKELMEGLTAKVFRTYNASITLQEQLDKLTNPDDPIHEKLLSYNRANRQVAILCNHQRAVPKSHDKAMENLENKIKDKKAEYKKTKAELKKNKSDEKLQKKYLRVKEQLDKLKTQRTDKDENKQIALGTSKLNYLDPRISVAWCKKYEVPVEKIFSKTQRDKFRWAIDMAREDFIF

SEQ ID NO: 59 - protein, 374 aa, Pratylenchus zeae
MSQSAEEAQLASCQAYVRQHNIQQLVKDAIVSLCIHKPDNPVLFLRDHFDRLAAEQQRQQFSQETVHNVPDEDDTLEEPPRLPQGNRRRLGGSAEVPDENEAANYQRVVIPKDEDTQKALRQAMCKNVLFAHLDLDEQKAIFDAMFPVEKHQGETIIEQGEEGDNFYVIDSGEVDVFVNGEYVLSIKEGGSFGELALIYGTPRAATVVAKTDLVKLWAIDRLTYRAILMGSTMRKRKMYDEFLSKVSILADLDKWERANVADALEQCQFEQGTHVVEQGQPGDEFFIIVDGEADVLQRPNEEAAFEVVGNLGPSDYFGEIALLLDRPRAATVVAKTPLKCVKLDRNRFERVMGPVREILKRDVSHYNSYVKLMT

SEQ ID NO: 60 - protein, 451 aa, Pratylenchus zeae
MSTAVSPSLSMENWKADLNLPTKDLRYKTADVTATKGIEFEEFGLSRDLLKGIFEKGWERPSPIQEASIGIALSGQDILARAKNGTGKTGAYCIPCIEKIDTSKENVQAMIIVPTRELALQTSQICVELSKHLNIKVMVTTGGTDLRDDILRLNGVVHLVVATPGRILDLMEKGVANVSQCKTVVLDEADKLLSQDFQGVLDRLVHFLPHDRQIMLYSATFPRTVATFMNKHMQRPYEINLMEELTLLGITQFYAYVQEKQKVHCLNTLFRKLQINQSIIFCNSTQRVELLAKKITELGYSCYYIHSKMAQHHRNRVFHEFRQGHCRNLVCSDLFTRGIDIQAVNVVINFDFPRNSETYLHRIGRSGRFGHLGIAINLITYDDRYNLRRIEKELKTHIEPIPKEVDPKLYVAEHQLDHEVFDHDEQQSSMMNNNHHIHSNATDSEEQNLSG

SEQ ID NO: 61 - protein, 199 aa, Pratylenchus penetrans
DQVGCCSLRCEHIKLHDEMDGQKYVVEFDFLGKDSIRYYNRVPVEKAVFKNLKIFVEGKEPGDDLFDSLDTSSLNVYLKELMDGLTAKVFRTYNASITLQEQLDQLTNANDSIHEKLLSYNRANRQVAILCNHQRAIPKSHEKSMETLENKIKDKKKEYKEIKAELKGKKGDEKLQKKYVRVKEQLEKLKTQRTDKDEN

SEQ ID NO: 62 - protein, 260 aa, Pratylenchus penetrans
MGQSLRRLRRNQQAITVEGGQKREEGGEQQQKSTPAAAPQGGSAGNSGGDGSPRKALAEKGNQQKKETAHNVPDEDDTLEEPPRLPQGNRRRLGVSAEVPDENEAANYQRVVIPKDENTQKALRQAMCKNVLFAHLDFEEQKAIFDAMFPLEKSKGETIIEQGEEGDNFYVIDNGEVDVFVNGEYVLSIKEGGSFGELALIYGTPRAATVVAKSDLVKLWAIDRLTYRAILMGSTMRKRKMYDEFLSKVSILSDLDKWER

SEQ ID NO: 63 - protein, 173 aa, Pratylenchus penetrans
MSTAISPSMSVEDWKAELKLPQKDLRFKTADVTATKGLEFEEFGLTRDLLKGIFEKGWERPSPIQEASIAIALSGQDILARAKNGTGKTGAYCIPCIEKIDSSKEYIQAMIIVPTRELALQTSQICVELSKHLKIKIMVTTGGTDLRDDILRLNGIVHLVVATPGRVLDFMEK

SEQ ID NO: 64 - protein, 381 aa, Pratylenchus scribneri
MFRLPLALSLILLLCVTLVSNSKWRIQRDLEDISSTSDETADIQDIRIEPSSPVRNGLNHLRQLIERGFADWRNFKERHGKSYPNQDEDNERMLAYLSAKQFIEKHNQAYDQGKITFKVGENSIADLPFNEYRKLNGFKRAMGDRMRRWNSSSFMPPLNLEDIPESVDWRDKGLVTAVKNQGMCGSCWAFSATGALEGQHARKLGQLVSLSEQNLVDCSKKYGNMGCNGGLMDNAFQYVKDNNGIDTENSYPYKAKTGRKCLFKAGDVGATDTGFVDLPEGNEEKLKIAVATQGPVSVAIDAGHRSFQLYTHGVYNEKECDPESLDHGVLVVGYGTDPEQGDYWIVKNSWGEKWGEEGYIRMARNKNNQCGIASKASYPLV

SEQ ID NO: 65 - protein, 381 aa, Pratylenchus scribneri
MFRLPLALSIILLLCVTLVSNSKWRIQRDLEDISSTSDETADIQDIRIEPSSPVRNGLNHLRQLIERGFADWRNFKERHGKSYPNQDEDNERMLAYLSAKQFIEKHNQAYEQGKITFKVGENSIADLPFNEYRKLNGFKRAMGDGMRRWNSSSFMPPLNLEDIPESVDWRDKGLVTAVKNQGMCGSCWAFSATGALEGQHARKLGQLVSLSEQNLVDCSKKYGNMGCNGGLMDNAFQYVKDNNGIDTENSYPYKAKTGRKCLFKAGDVGATDTGFVDLPEGNEEKLKIAVATQGPVSVAIDAGHRSFQLYTHGVYNEKECDPESLDHGVLVVGYGTDPEQGDYWIVKNSWGEKWGEEGYIRMARNKNNQCGIASKASYPLV

SEQ ID NO: 66 - protein, 468 aa, Pratylenchus scribneri
MEKEDTKNIEKVENCADTFEKLKINTELCSACERIGWKKPMPIQQKIIPLALAGKDVIGLAETGSGKTGAFALPILQALMENPQRLFAVVLAPTRELAFQISEQFEALGATIGLQVCTIVGGIDMSTQTLSLSKRPHIIVATPGRLVDHLENTKGFDLRPVKYLVMDEADRILNMDFEVELDKILKVIPKTRKTYLFSATMTQKVSKLERAHLKNPARVELSSKYQTVSTLIQNMLFIPFKYKEAYLVYVLNEKAGNTAIVFVGTCASAVKLALMLRHLGFGAIALHGQMSQPKRLGALNKFKKKDRPILVCTDVASRGNFLLLIRFYMLNLKGLDIPHVDMVLNYDVPAHSKDYVHRVGRTARAGKSGVALTMITQYDVEIYQKVENSLGKKLDPMEVNHEEVMELVERVSEAGRIAANRYKEMVDGAKGGGRRRKLLGENEDEDLEPARKHQKASLQQHNKMRRKK

SEQ ID NO: 67 - protein, 1070 aa, Pratylenchus scribneri
MQTINIGEPVYKKPKMHGNGQVCSPNSIAPTKENGQENDQQKTQQQQKENSMDSGGVDTNLYSRQIYALGESAMSHLRKASVLVSGIGSVGLEISKNLILGGVHNVTLHDQKQLTFNDLSAHFYSSEANIGQNRVQTCFEKLAELNDTVNCSISTEPLIQDFISQFDLIVITDTSWEQQITLNNWARKNGKTKFIAADARGLFSYAFVDLGDQFQVNDSDGEACKEILLEHINTETGEIHTLEGTFHGLEDGDQIVLEDFEQAQLNNLPPMTIKTANKGNILNVEKRWRHLPIYPGTNHSRRANSESAQMITFQSWSCMMSRILIWTLPNRPTPQLHSLWQACIAWEKGRSPQPRSKEDAELLKKELLEGSPEIPEELLNNFSYQATGNLQPIASFIGGFVVQEAMKAVTHHTMPLRQFLYTDSCEALPGEYSTFDSAKLTMEDCAPRNCRYDGQAAVFGWAFQEALERQHWFIVGAGAIGCELLKNFAMMGAACDKNGAGQLTITDPDTIEVSNLNRQFLFRRPDVGKKKSEVAANAVQKFNPALNIRPLAEIVAESTEQIFHDDFFHQLNGICNALDNVEARRYVDRRCVYYQLPLLESGTMGTKGNTQVVYPHLTESYSSTSGPPEKETPVCTLRNFPYQIQHTIQWGKAKFVDHFTSVAETVNQYLDDVAGCLRRMKEQMNQGQQLELLRTLNRALIEECPKTREDCVYWARDLFDTLYRNDIQQLLHNFPPDQVTSHGQKFWSGTKRCPHPLTFNVLDKDHFEFVYTASILRAQLYNLEPILNRLDVANLAQAYQSKPFVPRDGVRIAVTDAEATNEAENGAGADGEDDVERILDVLNVNLARLNLGNIQRFTPIDFEKDDDTNHHVDFITAASNLRADNYNIEKADRMKTKQIAGRIIPALATTTAIVSGLVCIEFYKTIEAKGIAKTPIERFKNAFLNLATPFIAFSEPGKAAKKKYRDIEFTLWDCLEVNGPMTLGQLIEWIEAQTGLTVSMMSSGVSLLYAFFTPPARVKERKEKDLLKVVEEVSKNPVPEFRRSLVFEVITQNDQDEDVEIPYIKYNFRR

SEQ ID NO: 68 - protein, 489 aa, Pratylenchus scribneri
MVMEQNGNLGEQVEEIAAGHHMTPVDMTTATSKLQLEAAEIRSPVNKPNWTSYLRSQLVPQNEYNFIVALEAAKNKAERDEVLNRDPNNSAKCIINLIIEVAKDQLIRYVLTVFDDLLQEDKARVEIFHEYSRRQKRTIWSWFQGILTRNDGFIVNQMSAIFAKLACFGTVHMEGQELNAYYNFIKGELRNSNNEYINTSVRCLQMMLRIEEYRHAFVATDGVPSIMSALDGRANFQLQYQLIFCLWCLSFNSNIARYIQSSGVIQALGDILSECSKEKVVRIILHTFRNLLEKIDNRDLVRESALQMVQCKTLKTLELMDAKKFDDEDLLEDIEFLSERLHTSVQDLSSFDEYCTEIRSGRLQWSPVHKSEKFWRENAQRFNEKNFELIKMLIRLLDTSGDPLVLCVAAHDVGEYVRHYPRGKTIVEQYQGKQAVMKLLSAEDPNVRYHALLAIQKLMVHNWEYLGKQLDAEGGNRSDEAKSETKNRT

SEQ ID NO: 69 - protein, 552 aa, Pratylenchus scribneri
MNNKQHAEITPQYGVSLPICTKPPTERDMRLTRELEEHMRRCGLFESDADMQRRLEVLRRINMMVKKWVKEVSVDKVPPDQLDHVGGKLFTFGSYRLVHTPGADIDSLCVVPRHIDRSDFFTSFYEKLKEDENTSDLHKVEDAFVPVIKLHYNGIELDILFARLALKEVSDSQQLSDDNLLRNLDEKSIRSLNGCRVADEILRLIPNHRNFILTLRAVKLWAKNHGIYSNVLGFLGGVSWAILVARTCQLYPNAAPAILLEKFFLVFSQWEWPFPVVLKDADATSRTDMPYFADMIWDPRSRISDRYHLMPIITPAFPEQNSTFNVTKSTRQVMINEFKEGLNTMIEITKGEAGWDKLFEEINFFTRYKHFIALLCVTANEEDHLIFNGLVESKIRHLVASLERNPCVALCHVNPRQYKPNPTLHVDIDYENPVCTLWFIGLEFNRDLQKSMNINLTDEIQAFVTNTVSVSAATMKDFKQTMQLRPAYTKQKDLTKWLNFEDLNRGRRVIRTTIKRPSSILDSSADSANGSPSAKTQKVEANNNKMEVKNKN

SEQ ID NO: 70 - protein, 474 aa, Pratylenchus scribneri
  MOD_RES (176)..(176): Any amino acid
  MOD_RES (184)..(184): Any amino acid
MGIKFLEFVKPFCGFVPEVSKPERKIQFREKMLWTAITLFVFLVCCQIPLFGIMSTDSADPLYWLRVIMASNRGTLMELGISPIVTSGLIMQLLAGAKIIEVGDTPKERALFNGAQKLFGMVITIGQAIVYVASGMYGNPHEIGAGICLLIVIQLVVAGLIVLLLDELLQKGYGLXSGISLFIXTNICETIVWKAFSPATMNTGRGTEFEGAVIALFHLLATRNDKVRALREAFYRQNLPNLMNLLATVLIFAVVIYFQGFRVDLPIKSARYRGQHSSYPIKLFYTSNIPIILQSALVSNLYVISQMLAAKFGGNILVNLLGTWSDSSGTYRSYPTGGICYYLSPPESLSHILEDPIHCLIYIVFMLGSCAFFSKTWIDVSGSSAKDVAKQLKEQQMIMRGHREKSMIHELNRYIPTAAAFGGLCIGALSVTADFLGAIGSGTGILLAVTIIYQYFEIFVKEQQEMGGVAGLFF

SEQ ID NO: 71 - protein, 3444 aa, Pratylenchus scribneri
  MOD_RES (1)..(2100): Any amino acid
  MOD_RES (2427)..(2707): Any amino acid
  MOD_RES (3090)..(3444): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDMSLDDALHRGLIDPNSEWIVPSRASGVGPTIEERTQETVTETGQQLAPKIYPDKELQETVNTVKRVKRTETSAVGGPGGVSVYRAVTGGKGSIEVPASGYHVLEAERKGLLDLGRGIVHPPGTDKSLSLEEAFNLGILDPRSINIRDPQSGRNLSVDEAMQQRILDKHGFVTHHGRRMTLQEAIDERIAHVEPESPATIGGGQNKKVIQFSSTAGPAVAFRPVGRPVVEEYEQSWAFDSNEGTFIDLATNERIPLDSAIRSGRISADDLVARDTLTGREYSLAEAEKWGIVNIRDGYYLDKQTQTIFICRSRSPPSNLSNGGIPEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGADGLEKGEYFDPTSNMKFTIQLHGDPVTTQTAQSSIHITSSIRGIGTARQFVGIDQIKDMRNGRVMSLADAQRLGLARVDRKGKQSTKEYSAFRSNIELAVNKGIMDGRGEKLSLEEAIRQRLLDIRELKYNHPRTGEAIDLSSAANQGLVDVTLAETLPSGVHHPGTGEKISVKHAVDIGIVDGRTGEVRHPFTGEKLSWVDLTRKVYNAITQNGVYDPRKGYAVPVASALSEGLIDTRAGAYLNPITQERITLEDANRRGLIDSQTFHALTMPCLTDHRSRRKMNLVEAVDARLIDPRAKTVQISADRIVPLQKAVDDGTIPREIGEHLRRVDKMTFAEAVGKGLIDVAQDQFTDPESGKQMSIAEAVQHGLIDTGTVKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 72 - protein, 1002 aa, Pratylenchus scribneri
  MOD_RES (1)..(106): Any amino acid
  MOD_RES (905)..(1002): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFHFDVHEQKILVGFAREVVPAESPQQCLTACLDAFDTFGFECESVMYYPVDAECILNTEDRLDRPDLFVDEHEDTVIYLDNNCAGSQCYAPYVTQYVAVEGKQLADELDQTFDGIELAECEERCTQRLSITANDFNCKASMYNNQTRRCILSDERSKPLGRAQLADAQAPGWTYHEKKCFASPRTCHNVPSFTRVPQMLLVGFASFVMENVPSVTMCLDQCTNPPPETGQNFVCKSVMYYYNEQECILNAESRQSKPDLFIPEEDDFVVDYFDINCRLEAEQCVDGRTPKLVRTLNAALPEGDGSIHVLETVQANVQDCAQKCVEHAPDKCRSFNFDKSSGTCNLLYLDGRGSLRPELKAQVDLYDVHCLNNGQQTAEAGHSPLGCIDPDGAIFSRNLYTRWVANSPNKELASLPLSKCLILCSTADEQCEGVNYNRRSVPVNIRFIECTFYYFYSAPERVNMSTSTDVCRVREEVATREGREEDGQGQSGAANVPKVPLTANRSWSGTHDQGPHSKLNNRTAAATKKPTVRIPEIPTKKSPPKEGINPEETSSTTKQPAESTVAVQFGAPNKPVVGNGIDDNQITGHKPVITENVGGRIGVTNKGPDPNELPAPVQIPASEVHTICNYEGISVQIKHSEPFSGVVFVKNKYDTCRVEVEAKESVTLVLGLPANFGMKPISLNPNPSVSAAKKKAKANADATLAVENSPHNESSTTASDSSSSAETAAEVAAQQQRKRHRRQTQRDCGLQDMDNGTYKSVVVVQTNNLGIPGLVTSMDQLYEISCNYSSMLGGKVQAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 73 - protein, 580 aa, Pratylenchus scribneri
MDLLQAYKGDSSSSDECDDDVSMSEGEGTSGINLAPNRSEEKYALALPKVDLAPQVIAHQPIQTVAVVDPKTKELYYNPKYEELFQPETGPQNPFKSEHQRAPKNMLTGYVEPAHFNQFHFERAIRSYDTLGYAENPSADAGNTFVGDVNKAKEEGGKSLFESKKTGGQKRKKVVNYDASDIDGYTGPWARYENEKTVAKPDAELQKEMDEIVQKRKMKSRIGRKLAVEELHLAEESTKLHIKDDKDYLGRSFMEAPKSVGVNLRPDHVPERCYPPTKQAHTYAGHTKPVTAIRWFPKSAHMFLSCSMDGKVKLWEVYGNRKLIRTYTGHKVPVKDIYFNNDGTEFLTAAYDNYIKLWDTETGQVKSRFTIGAHRAYVIKFNPDGDKQNLFIAGMSNKKIIQWDTRSGEIEQEYDRHLGPVNSITFFDKNRRFVSTSDDKSLRIWEFGIPVDTKIIQHAGLHSIPSMTRAPNEKWIVGQSMDNRIVLFQIVDDKLRFARKKAFRGHNTAGYACNSDFSPDMSFLTSGDADGKITIWDWRTHKIVSTWKGHDNVCISVLWHPHEQKRMISCGWDNSIKMWF

SEQ ID NO: 74 - protein, 317 aa, Pratylenchus scribneri
MTCSYIAFAGYIAIVYALLKLLRSVYNVVFPYLFAVPQNLPVLAGAKWAVVTGSTDGIGKAYALELAKKNFNLVLISRSMDKLNNVAEEIRKKFDHIDVKTISFDFTNAQLDDYEKTIFNELNQLEIGVLVNNVGMSYEYPERFDQVEGGLKRLTDITVINTVPTTVLSAFVLKQMATRHRGIVINVASSAAYFDWFYLAVYSATKKYVCWLSSILRKEYADTGIIVQTVCPMMVATKLAKVRKASFFTPTPEKFAYEAVRSIGLIEETTGCLAHQIQAEIMFGYVPTFFLNKFMKDNSLQTRKRALKKKEAAAVSE

SEQ ID NO: 75 - protein, 253 aa, Pratylenchus scribneri
MFRNQYDSDVTVFSPQGRLHQIDYAVEAMRQGSATVAIRGKDHAVVVALMRAQNELSSYQQKTFQLDDHVGLSMSGLLADGRILARFIQGECASFKWENQTALSISDLRTKLILKLQENTQYYGRRPFGVGLLIIGYDDLGPGPHVLSADPSGNVEEVVAAAIGARSQSARTYLANHKDDFREADLDNVIKHALRALKETLATDAGKLDEHNTAIAVVGKRQKFECLEREQVKTHIADIDGANGGGGDQQMQE

SEQ ID NO: 76 - protein, 605 aa, Pratylenchus scribneri
  MOD_RES (541)..(605): Any amino acid
MPPSTRDGVKEAQYGFVYGVSGPVVTAEKMSGAAMYELVRVGHSELVGEIIRLEGDYATIQVYEETSSVTIGDPVLRTGKPLSVELGPGIMSSIFDGIQRPLQDIAAMTTSIYIPKGINVNALSRSKSWEFEPRKGVKVGDHVTGGDAIGLVHESMLVKHTIMVPPNACGTIKYIAPKGNYNVTDIILEVEFSGDVQKFPMVQVWPVRQPRPVAEKLAANYPLLCGQRVLDALFPCVQGGTTAIPGAFGCGKTVISQSLSKYSNSDAIIYVGCGERGNEMSEVLRDFPELEMEVDGKKTTIMQRTALVANTSNMPVAAREASIYTGITLAEYFRDMGLNVAMMADSTSRWAEALREISGRLGEMPADSGYPAYLAARLASFYERAGKVKCQGSPEREGSVTIVGAVSPPGGDFADPVTSATLGIVQVFWGLDKKLAQRKHFPSINWLISYSNYMRALDDYYEKNFPEFVPLRTKCKEILQEEEELSEIVQLVGKASLAESDKITLEVAKLIKDDFLQQNGYTKYDRFCPFYKTVGMLKNMXXXXXXXXXXXXXXXXXXXXXXXXXXXXXXXXXXXXXXXXXXXXXXXXXXXXXXXXXXXXXXXXX

SEQ ID NO: 77 - protein, 1192 aa, Pratylenchus scribneri
  MOD_RES (1)..(18): Any amino acid
  MOD_RES (754)..(1192): Any amino acid
XXXXXXXXXXXXXXXXXXDEDDEISTELWQEACWVVISAYFDEKGLVRQQLDSFDEFIQMIVQRIVEDSPAVELQTELQHSAGEIEAPTKFSLKFGQIYLSKPTHWEKEGAPTPLMPNEARLRNLTYSSPLYVDIVKTISKEGEEDIVQEYPKVFIGKIPIMLRSSYCVLSNLTDRDLTELNECPLDPGGYFIINGSGKMLIAQEKMATNTVYVFAMKDGKYMYKTECRSCLEHSSRPASTLWVNMTNRGGKGGKNPTGQRIVAIIPYIKQEINIIILFRALGFVSDRDILEHIIYDFEDQEMMELLKPSLDEAFVVQEQSVALNFIGTRGAKPGVTKEARIRYAKEILQKEMLPHVSIAEHCETKKAYFLGYMVHRLLLAALGRRELDDRDHMGNKRLDLAGPLLASLFRALFRNLLKEVRLTAQKYINKNGDFNLDVCVRPTIITRGLAYSLATGNWGEQKKAHQTRAGVSQVLNRLTYTATLSHLRRCNSPIGREGKLAKPRQLHNTQWGMVCPAETPEGQAVGLVKNLALMAYISVGSMPEPILEFLEEWSMENLEEVSPLAIANSTKIFVNGSWVGIHRDPDQLMTTLLKLRRQMDIIVSEVSMVRDIRDREIRINTDPGRVCRPLLIVSDGKLMLKKRHIELLKERDNAETPFTWSDLVQNGVVELIDAMEEETIMVSMTPEDLKSGGYCETYTHCEIHPAMILGVCASIIPFPDHNQSPRNTYQSAMGKQAMGVYTTNFHVRMDTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 78 - protein, 740 aa, Pratylenchus scribneri
  MOD_RES (334)..(740): Any amino acid
MERDGTNIQRQRQNQRRIASSNIRSRPQSQLPLSNSFILLLICLLPHPLLAIFECGPHETATFVRISRARLDGTPLVVSTAGHDLTCSQYCRNNIEPTTGAQRFCASFNFDGRETCYFFDDTAAPVAGQAELNPNPSANNFYYEKMCLPGLNSHEACTYRSFSFERIRKTALEGFVRKSIQVASREQCLSACLKEREFVCRSVNYNYDTYACEMSTEDRRSKPTNLRMMDQPVDYFDNNCLNRQNRCGQQGGNLVFVKTTQFEIKFYDHTQSVEPQESNCLQKCLDSLNTFCRSVEFSPNEKNCIVSDEDTFSRADQQAAVQSKDYYEPICVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 79 - protein, 619 aa, Pratylenchus scribneri
MTSNNDIVAQLQDAANRMRVSSIEQTCKANSGHPTSSCSAAEIMATLFFAEMRYDVKNPRHPAADRFILSKGHACPILYAAWEEAGLLTNDQVLSLRRIDSDIEGHPTPRLNFIDVATGSLGQGLSCAAGMAYAGKYVDKASYRVYCLMGDGESAEGSVWEAAAFASYYKLDNLVAIVDVNRLGQSQQTMLQHDLQTYTKRFEAFGFNSIVVDGHDINALVKAYADAKNTKGKPTAIVAKTFKGKGIDGVEDQDDCHGKPVKMDKADQIRAILKSKTPVKWNIPKPVEDAKEVDLGLGRIKMSKPPQYEIGQKVATRLAYGDALLKLADVNKRVITLDGDISNSTFSNKVLKKYPDQFVQCFIAEQNMVGVGVGLACRGRAIPHISTFAAFFTRSGDQIRMAAVSFANAKFTGSHVGVSIGEDGPSQMGLEDIALFRALPDSIVLYPSDAVAAEYATELAANYNGITYTRVSRPNTPVIYANNEKFEIGKCKVVREAPQDKFMLIGAGVTLYECIKAHDELKADGINVCVVDLFSVKPLDVEMLTKHAQRVGGKVLTVEDHYQAGGLGEAVAMALADIPNVRVRHICVKELPRSGPPDALLDLYGLSSKHIVAALQNYD

SEQ ID NO: 80 - protein, 588 aa, Pratylenchus scribneri
  MOD_RES (1)..(158): Any amino acid
  MOD_RES (546)..(588): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSAQIEVIPCKVCGDKSSGVHYGVITCEGCKGFFRRSQNHQHPNYQCARNSNCPVDRVSRNRCQYCRLKKCIELGMSREAVKFGRMSKKQREKVEDEVRLHTQRSGTDFSTSAPLSTPPAISASGQYHQQAHFMSAPPSVGPPTPGSSAGVEIKYPRTPMFAGIYGQVVPTGPFHVNGGEGREEDQQQQILHLHNAQHGHHFIGGGHPLGQQHNNNGGTQQQLVLGQPSCSSASVSSPLIYSQQSQQQMLPHACAPISYSLMPSFCQQQQPIAQQGAVPSSSGGYPIHESELGMVHSSNGHVSSTVDDDLIKQVSRAYEIAHRLPRPSFEDWQIDAQQVDRLKNMSRLNGWLKFAKELTDVIKSIIEFAKALNEFKKLGQEDQINALKXXXXXXXXXXXXXXXXXXXXXXXXXXXXXXXXXXXXXXXXXXX

SEQ ID NO: 81 - protein, 435 aa, Pratylenchus scribneri
  MOD_RES (257)..(435): Any amino acid
MVVHYHLRLAILPTECLNQCQKLSTFTQNSLGGLCFSPTNPFMEQRRTIVDKYTLPSTLPYNYPEPYPYKEKGFQRHQIIPSRSLIRHHKNSKLIVVEGNIGSGKNFAAKLADELGFLYMPAFSMKDILVDRYGNDMRKFHDLFPKRFRIPDELMFYKNPSDDQTAVMQDLIYASKFEQYANALAHIFNTGEGVVMERSVYSDFVFANAMREKNWISMEFFKYYHFVRKVTLHYLRFWPHLVIYLDCPISKCLENIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 82 - protein, 340 aa, Pratylenchus scribneri
MTNKTLKSIRPPTALFLLQISAIFFSTFLLVNVRGVEVHFDSADKVQGQLPIVIPQGKMEKEGDKEIYKIEIKDHTKPCLFYAESMSVVLYDFKEKKQSAWATLNMTNTKGFVGDFECPKEGSNVGNSFRVDLTVNANDVPGYYSSDLVRKDESRVIFKVSKVDISLIFNFTQPAYWKLVDATVNEIQLSDGAATGLPKIGSDAKLVTGQGKDWNFADKHMPAWNINGFKDYAYSCARTNPIVWATEENKNYAVGVTLNNIQMQLNATSQREEGGKNYARFGFRVNDCAPLFSIGTWMGVIVALLLIGVLSFGFLMLNSVQTMDRFDDPKQKQLIINAKE

SEQ ID NO: 83 - protein, 157 aa, Pratylenchus scribneri
MIHYMFLFSRQGKLRLQKWYVAYPDKNKKKITRELITTILARKPKMCAFLEYKELKIVYKRYASLYFLCAVEQSDNELLCLETIHRYVELLDRYFGSVCELDIIFNFEKAYFILDEFLLAGEIQETSKKQVLKAISAQDLLQDEETTQGFFEDNGLG

SEQ ID NO: 84 - protein, 375 aa, Pratylenchus zeae
GINEELCNACDRIGWSKPMPIQEQVIPAALSGRDVIGLAETGSGKTGAFAPILQALMDCQQRLFAVVLAPTRELAFQITEQFEALGASIGLQVCTIVGGIEMSTQTLSLSKRPHVIVATPGRLVDHLENTKGFDLRTVKYLVMDEADRILNMDFEVELDKILKVIPKTRKTLFSATMTQKVSKLERAHLKNPARVELSSKYQTVSTLIQNMLFIPFKYKEAYLVYVLNEKAGNTAIVFCSTCASAVKTALMLRHLGFGAIALHGQMSQPKRLGALNKFKKKDRSILVCTDVASRGLDIPHVDMVVNYDVPAHSKDYVHRVGRTARAGKSGIALTMVTQYDVEIYQKVEASIAKRLDPMEVNHEEVMQLVERVSEA

SEQ ID NO: 85 - protein, 474 aa, Pratylenchus zeae
MSVKFLEFVKPFCGFVPEVSKPERKIQFREKMLWTAITLFVFLVCCQIPLFGIMSTDSADPLYWLRVIMASNRGTLMELGISPIVTSGLIMQLLAGAKIIEVGDTPKERALFNGAQKLFGMVITIGQAIVYVASGMYGNPHEIGAGICLLIVIQLVIAGLIVLLLDELLQKGYGLGSGISLFIATNICETIVWKAFSPATMNTGRGTEFEGAIIALFHLLATRNDKVRALREAFYRQNLPNLMNLLATVLVFAVVIYFQGFRVDLPIKSARYRGQHSSYPIKLFCTSNIPIILQSALVSNLYVISQMLATKFGGNILVNLLGQWSDSTGTYRSYPTGGLCYYLSPPESLSHILEDPIHCIIYIVFMLGSCAFFSKTWIDVSGSSAKDVAKQLKEQQMIMRGHREKSMIHELNRYIPTAAAFGGLCIGALSVTADFLGAIGSGTGILLAVTIIYQYFEIFVKEQQEMGGISGLFF

SEQ ID NO: 86 - protein, 1083 aa, Pratylenchus zeae
MQRFNTLIVDPEEPASKKARVLGNIQLCDPKNNGTVMPAQDTNTNNNSAVQHARNGGGHGDHDSGVDTNLYSRQIYALGESAMAHLRKASVLVSGLGSVGVEIAKNHILGEVRHVTLHDQKDLTYKDLSAHFYASEADVGHNRVRICAKQLAELNDTVNCAVSTDALTEEFVKQFDLIVLTDSPWELQIQVNDWMRKHGKMFISADARGLFSYAFVDLGDQFAVTDPDGEACKEVLLEHINCETGEIFTLEGIYHGLEDGDHIVFEDFEQQELNELNPIPIKTTAKGNIMNVGQALAQYKSMLEAPLTRGRAKQVKVPKNVAFKSLAEALKEPEILIWDFAKFDEPAQLHFLWLALYQFEKRHGRSPKPRSNEDAQLLKNELPSNAPEIPDNLLNNFSYQATGNLQPIASVIGGFVAQEAMKAVTHHTTPLKQFLYTDSLEALPGDYSQFDAAKLTPKDCAPRKSRYDGQAAVFGWAFQEALEQQHWFIVGAGAIGCELLKNMAMMGLACGEKGQLTITDPDTIEVSNLNRQFLFRRPDVGKRKAEVAARAITGFNAAVKIRALSDIVSEATENVFNDDFFLDLHGVCNALDNVEARRYVDRRCVYYQLPLLESGTMGTKGNTQVIFPHLTESYSSSNDPPEKETPVCTLKNFPYQIQHTIQWARSKFGDYFTSTAETANQYLDDVTGFLARLNTMAPSQKIEVLRALNKALIDECPKSAEDCVNWARELFDQQYRNEIMQLLHNFPADQVTSQGVRFWSGTKRCPRPLTFNVNNEEHLQFIYAASILRAQLYNFQPITDRARVAQLAAAFQSKPFQPKEGVRIAVTDAEAANQAEGGEPDGNADVVERRVDELSVRLARPPILQIQRLNPIDYDEEDDANHHVDFITAASNLRAENYSIEKADRMKTKQIAGKIIPALATTTAMVSGLVCIELYKTIEADGLRSNAPIERYKNSFLNLAIPFIAFSEPGKAPKKRYRGDREFTLWDRLEVNGPKTMGQLIDWIETETGLTVSMMSSGVSLLFAFFQPPAKVQERRARDILAVVEEVSRNPVPDYRRAIVLEAITNNEQDEDVEIPYIKYNFR

SEQ ID NO: 87 - protein, 2893 aa, Pratylenchus zeae
  MOD_RES (985)..(985): Any amino acid
MYKVLQKYTRKRKHEQHGSGSGKDGGGPPRGGSYSYSRSRSEGAVNGAPPPPPVGANGYYSQHQSSQQQVHRNGGVHHSGSQQHLKRSQHAEEAAFHERSRSRGGGEYRNGFGSHHSGSMPPPGAVTERQHFYDAATGAHGFQENTSWETKEHFERKVQKGQKRSGSQMLGGTKEGSRARLDQWSSSGLAIDRGNLDDLVSRLTRGIGITNEELDHILTRIDAVDAAAERGERVEVLERQIREIVDDLYALKPPIDEFFVDVETLRQHRHPEAADFHKQVLGLEQRRTAYLGRLEDGIMVRLGIRSNKPQFMERYSSTHVSQAHKGNAFRRVEDAIQWVRDHTYKLNTMQFSETLEVLEQMFEQHKLDNRDIQDFRQTVDECIARQAEVSAEDSYDYCELLKILESEYQQLRELSAGRMVDLDSLIAFIRAAQLELVWIHEREELEVTRNWSDVQHLDIPMLQNYFKQLLHEIELHEKQFNDVHNQGAALINQRHPAGEVIEVYLRTMQNQWDWLLNLSKCLEGHLRDAYNAKAFLEEADQVEQQMHQQLNHLDQGYNRTEFSLDDGERMLRELDSIREHIQQLHARLLSLTERCSQISPLWQRGERIGRPIVTALCEYRSKEIHIRQGDECTLLDNHDLLQWRVRGMDGVEATVPSVVFRIPPPDPRLANLLSRLHGQFEKLRKSWDRKHHLVRYNMVLNTMRTVGWDLDTFLSIPPDQRDEIIKALNEDVNKLLAELDPNDPLARRLKEELRLTNEHFYDLLARAQRGPEPDYSNEFDHAAAELIRKFEEAWKQLSERAQVRIPGNMDELEHQIKEHKVFEDNLQALDVDVSNVKELYRQLPNPTPNQRAKHDLMISRWEEIWELCRMYVERLKALENVLKSVDEVTDIVRRHEVTLSSFDDMPSALERLRGVHAQLVELNMVLQQQRSIVENLNKDTAQIRSHVARTRLGVQHHPDVDQLEEIVTSLTVRWDNVNSQVTDRXRIAEEAQQTQMVYRSQYDEELQWLDRVEATINSLRRPEELRPEELQGQLDQLTAEYAQLQEHTATIENINKEGGKFIRDAKGYDIKLAQYHDNTISFHGQSIKEEFRRQVPQPKNGAQIVTEELEALNRRFAQLSSVILERKNIVNVLIQNWRRKQQAAQLHEQVPMQQADEFVEVREMPEVPHVAIYEDEPQMFQEETVTKTQFYEMEGILHKQTGEILTFVEAIRQGLLDLSRGGEFFDIVSGSRVSLDKAVEMGLISENITETLNSRHGIRHPETGEEVTLMEAIQIGLYDPDSRQLRDIKTGDLLSLYDSRHICPTDVQHRLIKMGVLKLPPMELEQALKNGVLNPQTGQFRGKYVQDPIPLRDALINGYIQFPSGQPLLALTLSDCIGDGYIDAHSGEFVDRHGSSGEKFTLRDALDRQRPLVRDNVRECVNTAINQRITVADALVAHALNPRSGKFTDLQSRAELSLRQAHDFGLIQKPLTLTEVLEKGQYDSSGHFLDRGNRFTLLEAINAGLLDPEVRHIVSEQDQEVLSIADALERGLLSPDGRIVLEWGPNGQQEKQMDLYDAQRQGLLTRRVRHTIFDVKGIRNTENNANLSFNEAAEAGILQVSAERVLDQQLQQTFMLSDAVQKGLMDSALADILSTPSGLSDSGGEVSLIRAVAKGLVDATKGVILDRRSQRELTVREAYDRGLFTSLRAAMRLAALFDVHPLLMTPVKKKPHKARRIQRPGQPLAGDQVKVTLAEAMRQGLIDARTQRFRQGNQEMSLDDALHQGLIDPHSEWIVPSRASGVGPTIEERTQETVTETGQQLAPKVYPDKELQETVNTVKRVKRTETSAVGGPGGVSVYRAVTGGKGSIEVPANGYHVLEAERKGILDLGRGVVHPPGTDKSLSLEEAFNLGILDPRSVSIRDPQSSRNLSVDEALQKKVLDRHGFVQHHGRRMNLQEAIDERLAHIEPEPPATLSQANKKVIQFSSAAGPAVAFRPVGKPVVEEHEQAWAFDSNQGVFIDAATNEHIPLDSAIRSGRLSADDLRARDALTGRDYSLSEAEKWGIVNIREGYYLDKTDNKRYSFAEAARQHRIYPTGGVPENAADALHTTVRVHTRSEVALKEAVPSSGQGGHGPVEYNLHRYVQHQQFDPSTGLFSHPDVQKQMTLKELIIKGLLNPYSTRIVDKANGTELRLLDAIQEHIVDDVAGTVRDTQTGRVHDFASAVRQGLVKEDPLAIESVFEDRRTSRTSVGGGGSPRLVERKLQLTPYAQEPFRGSSPSGGFGASGGSGSLGAREGGGTSSWSPTGPTQPKQHRGEESVVRREFTSSSTGGAFGGPTFGGAVPGAGFSSAFGNQQQAVTPYGNGPSTTGPNERMVDLGGGKTVKVNVIRGADGLEKGEYFDPASNMKFTIQLHGDPVTTQTSTKVRSTSQVQSVELEPHAQFVGIDQIKDMRNGRVMTLADAQRLGLARVDRKGKQSTKEYSAFRSNIELAVNKGILDARGVKLSLEEAIRQRLLDIRELKYIHPRTGEAIDLSSAANQGLVDVTLAETLPSGVHNPATGEKISVQRAVDLGIVNGRTGEVRHPLTGEKLSWVDLTRKVYNAITQNGVYDPRKGYAVPVASALAEGLIDTRAVAYLNPITQERISLEEANQRGVIDSQTYHALTTPCLTDHRSRRKLNLVQAVDAKLIDPRAKTVQISDKIVPLQKAVEEGALPREVGEQLRRVDKMTFAEAVGKGLIDVAQDKFTDPESGKQISIAEAVQQGLIDTGAVKTGNDEPGENTNLARLIQSEHFDEKSGRVQDPRSGLALPFGTAVNQRMVDPDSLLHDLESSKTMTIREAINMGLVDSHGRYVPSKGAAQSVPLKEAVQRGLVALIGSPMQAAQAVSEALKRRDAEGYKFRLEPLDDTTVQRLS

SEQ ID NO: 88 - protein, 471 aa, Pratylenchus zeae
MAIEQNGTLGEQVEEIAAGHHLTPVDMTTATSKLQLEAAEVRSPANKPNWTSYLRSQLVPQNEYNFIVALEAAKSKAERDEVLNRDRANSAKCIINLVIEVAKDQLIRYILTVFDDLLQEDKSRVEIFHEFSRRQKRSIWSWFQGILTRNDGFIVNQMSTIFAKLACYGSTHMEGQELQTYFNFLKSELRNPNNEYINTSVRCLQMMLRSEPYRRAFVDCDGVPTIISALDGRANFQLQYQLIFCLWCLSFDSAIAQYLQSMGVIQTLGDILSECSKEKVVRIILHTFRNLLEKIDNRDLVRESALQMVQCKTLKTLELMDAKKFDDEDLLEDIEFLSERLHASVQDLSSFDEYCTEIRSGRLQWSPVHKSEKFWRENAQRFNEKNFELIKMLIKLLESSGDPLVLCVAAHDIGEYVRHYPRGKTIVEQYQGKQAVMKLLSAEDPNVRYHALLAIQKLMVHNWEYLGKQLD

SEQ ID NO: 89 - protein, 1062 aa, Pratylenchus zeae
  MOD_RES (1)..(295): Any amino acid
  MOD_RES (486)..(660): Any amino acid
  MOD_RES (785)..(843): Any amino acid
  MOD_RES (874)..(885): Any amino acid
  MOD_RES (945)..(1062): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKNFLAPRTCRNMPSFTRVPQMLLVGFASFVMENVPSVTMCLDQCTNPPPETGQNFVCKSVMYYYNEQECILNAESRQSKPDLFIPEEDDFVVDYFDINCRLEPEQCTGGRQAKLVRTLNSALPEGEGAIHVLETVQAGVQECAQKCGEHAPDKCRAFNFDKSSGTCNLLYLDGRGSLRPETKAQVGFFEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQIKHSEPFSGVIFVKNKYDTCRAEFNSEQSVTLVLGLPANFGMKPISLHHPGPSNNTNPDQSSSAEAAAELASQQQRRRHRRQSQRDCGLQDMDNGTYKTVVVVQTNNLGIPGLVTSMDQLYEVXXXXXXXXXXXXXXXXXXXXXXXXXXXXXXXXXXXXXXXXXXXXXXXXXXXXXXXXXXXGDILELRWEIMAMDDELDFFVKDCYAEPGIXXXXXXXXXXXXLIFSSCPTPAVAQKLIPNPIKVLSSAVKIAHLQAFRFDSSSTVRITCHLELCKGDCKSVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 90 - protein, 569 aa, Pratylenchus zeae
MELLQNYKGDSSSDEGDEMEEGTSSSFVGKHSQLAVALPSVNLAPQVIAQRDVQTVAVVDPKTKELYYNPKYEELFQPESGPSNPFKSEHQRAQKNMLTGFVEPAHVNQFHFERAIRSYDTLGYAENPSADAGNTFIGNVAKAEETGGKSLFESTKTGGQKRKRVVNYDASDVDGYTGPWARYENEQTVAKPDPELQKEMDEIIRKKKAKSRIGRKLAVEELHLAEESTKLHIKDDKDYLGRSFMEAPKSVGVNLRQDHVPERCYPPTKQAHTYNSHTKPVTAIRWFPRSAHMFLSCSMDGKVKLWEVYGNRKLIRTYTGHKVPVKDIYFNNDGTEFLSAAYDNYIKLWDTETGQVKSRFTIGAHRAYVVKFNPDEDKQNLFLAGMSNKKIIQWDTRSGEIEQEYDRHLGPVNSITFFDKNRRFVSTSDDKSLRIWEFGIPVDTKIIQHAGLHSIPSMTKAPNEKWIVGQSMDNRIVLFQIVDDKLRFARKKAFRGHNTAGYACYADFSPDMSFIASGDADGKITMWDWRTHKIVSTWKAHDNVCISVLWHPHEKSRMISCGWDNSIKM

SEQ ID NO: 91 - protein, 232 aa, Pratylenchus zeae
MVHWVFGVIGILALLLVLFKVLAALWRILWPYVLGRPKSLEALAGPGNWALVTGCTDGIGRAYAAELASRGISLVLVSRSAQKLAEMEAEFRRRFAKPDFLTVAFDFSEPSVAVYKQRLLAKIQHLPIGILVNNVGAMYTFPQRFHDANGGFEKMADVMTINMHPVTLLSAFVLDQMTKRGQGVIVNISSMIGYRPCFYQTIYAATKAYVNCLSQSLRLEYANQKGIHIQTV

SEQ ID NO: 92 - protein, 211 aa, Pratylenchus zeae
MFRNQYDSDVTVFSPQGRLHQVDYAVEAMRQGSATVAIQGKDHAVVVALMRAQNELSAFQEKIFSVDEHLGLSMSGLLADGRILAREVQRECAAFRHEFGAPISIQEVRSKLGQRLQKNTQYYGSRPFGVGLLLIGYDDLGPHVLKAEPSGMVTAEYAAAIGARSQSARTYLEKHMDAWKDGDLDTIVKHALLALKETLQADSNKLDQNVS

SEQ ID NO: 93 - protein, 370 aa, Pratylenchus zeae
MFPISRRGIKGKEGSVCGVSGPVVKAENMLGAAMYELVRVGHYELIGEIIRIERDTATIQVYEETAGLAIGDPVLRTGKPLSVELGPGIIGNIFDGIQRPLHDIAQITKSIYIPRGINVSPLNRTKKWDFEPNQRLKKGDHVAGGDVVGFVHESMLVKHKIMVPPTEQGTIKFVAPKGRYTVKDTIMELEYSGQIHKYPMYHVWPVRTPRPVQEKLATDHPLLCGQRVLDALFPCVQGGTTAIPGAFGCGKTVISQSLSKFSNSDVIIYVGCGERGNEMAEVLRDFPQLTMEVGSKTTSIMERTVLVANTSNMPVAAREASIYTGITMAEYFRDMGLNVAMMADSTSRWAEALREISGRLGEMPADNGYP

SEQ ID NO: 94 - protein, 1215 aa, Pratylenchus zeae
  MOD_RES (486)..(500): Any amino acid
  MOD_RES (1172)..(1173): Any amino acid
  MOD_RES (1207)..(1215): Any amino acid
MLFDDDDDMPRAFEDDDEPQEQPEDYEEYEQEEEEQGQEPMEYEDEDDEISTELWQEACWVVISAYFDEKGLVRQQLDSFDEFIQMIVQRIVEDSPAVELQTELQHATGEIESPTKFSLKFGQIYLSKPTHWEKDGAPTPLMPNEARLRNLTYSSPLYVDITKTISKEGEEDQVANYQKVFIGKIPIMLRSSYCVLSNLTDRDLTELNECPLDPGGYFIINGSEKVLIAQEKMATNTVYVFSMKDGKYMYKTECRSCLEQSSRPSSTLWVNMTNRGGGKAGKNAMGQKIIAIIPYIKQEINIIIVFRALGFVSDRDILEHIIYDFDDQEMMELVKPLDEAFVVQEQQVALNMIGTRGAKPGVTKEARIRYAREILQKEMLPHVSIAEHCETKKAYFLGYMVHRLLLAALGRRELDDRDHMGNKRLDLAGPLLASLFRALFRNLLKEVRLTAQKYINKNGDFNLDVCVRPTIITRGLQYSLATGNWXXXXXXXXXXXXXXXVLNRLTYTATLSHLRRCNSPIGEGKLAKPRQLHNTQWGMVCPAETPEGQAVGLVKNLALMAYISVGSQPEPILEFLEEWSMENLEEVSPLAIANNTKIFVNGSWVGIHRDPDQLMTTLLKLRRQMDIIVSEVSMVRDIRDREIRINTDAGRVCRPLLIVKDGKLALRRSHIEQLKERNPTAEQQYQWSDLVAGGVVELIDAMEEETLMVAMTPEDIKSGGYCDTYTHCEIHPAMILGVCASIIPFPDHNQSPRNTYQSAMGKQAMGVYTTNFHVRMDTLAHVLYYPQKPLVTTRSMEYLRFNELPAGINAIVAILSYGGYNQEDSVIMNQSGIDRGLFRSVFYRSYRDNEANIDNVNEELIEKPTREKCKGMRHALYDKLDEDGISSPGTRVSGDDVIIGKTIAIPEIENELEASAARYQKRDASTFLRSSETGIIDQVMITLNSEGNKFVKIRVRSIRLPQIGDKFASRHGQKGHNGGMMYREEDMPFTREGITPDIIINPHAVPSRMTIGHLIECLQGKLSANKGEIGDATPFNDTVNVQKIRQTLLAEYNYHLRGNEIMYNGFTGQKLTTQVFIGPTYYQRKHMVDDKIHSRARGPIQGMNRQPMEGRARDGGLRFGEMERDCQISHGCAQFLRERLFEVSDPYLVYVCNQCGLIVIANQRTNTFECKXXDKTQVSAVRIPYACKLLFQELMSMSIAPRMMVKXXXXXXXXX

SEQ ID NO: 95 - protein, 638 aa, Pratylenchus zeae
  MOD_RES (471)..(474): Any amino acid
VFECNPQETATFVRISRARLDGTPLVVSTAGHDLTCSQYCRNNIEPTTGAQRLCASFNFDGRETCYFFDDAAAPAAGTAELNPNPSANNFYYEKTCLPAVNAHEACSYRSFSFERIRKTALEGFVKKSIQVANREQCLSACLKEREFVCRSVNYNYDTYACEMSTEDRRSKPTNLRMTDQPIDYFDNNCLNRQNRCGLQGGNLVFVKTTQFEIKYYDHTQSVEPQESNCLQKCLDSLNTFCRSVEFSPHEKNCIVSDEDTFSRADQQAAVQSKDYYEPICVSADLSSSTCRQQAAFNRFIGVSIEGQPVATAQGVTVSDCISLCFQNLNCKSINYDRTQSTCYIFAIGQANANVKKNPSVDFYEFNCESQFGGMALCTNDGIRFIVNTKEPYTGAIYAAEKFSTCSQVVENAKQISITFPPPNVSPNCGTTIKDGKLEALVVVSLDGVMPHQVTTEWDRFYRVSCDVNMDXXXXEGTVVVTTIFETKEAEPQVLDAGTPPPITAALSFLDAEEQPLQKASIGDPIKLVVHSEQAGPHNMMLTECTATRVGGEGEAVPFTIIDNGCPRYPALVGPVEPDFDKNRLRADMKAFRLDGSYDVQIQCTIMFCAGPNGCPPSNCLDSGTNDLFLSHGRRKRHA

SEQ ID NO: 96 - protein, 615 aa, Pratylenchus zeae
MASSDVAQLQDAANRMRVSSIEQTCKSNSGHPTSSCSAAEIMATLFFSEMKYDVQNPRHPAADRFILSKGHACPILYAAWEEAGLLSKEQVLSLRRIDSDIEGHPTPRLNFIDVATGSLGQGLSCAAGMAYAGKYVDKASYRVYCLLGDGESAEGSVWEAAMFSSYYKLDNLVAVVDVNRLGQSQQTMLEHDVQTYANRFAAFGFHSIVVDGHDVNALLKAYAEARNVKGKPTAIIAKTFKGKGIEGAENEDNCHGKPVTMDKADKIRALLKSQTPVKWNIPKPAGDAQNVDLGIGRIKMSSPPQYKVGEKVATRQAYGDALLKLADVNKRVIALDGDISNSTFSNKVLKKYPEQFVQCFIAEQNMVGVGVGMACRGRAIPHIRHFCRFFTRAGDQIRMAAVSFANAKFTGSHVGVSIGEDGPSQMGLEDLALFRALPDSLVLYPSDAVSAEYATELASTNGITYTRVSRPNTPVIYANNEKFEVGKCKVLRQSAADKVLLIGAGVTLYECIKAHDMLSSAGTNVAVIDLFSVKPIDVETLSKEAQRVGGKVLTVEDHYQAGGIGEAVAMALADLPNVRVRSLFVKELPRSGKPEELVEHYGISAKSIVEAVKNY

SEQ ID NO: 97 - protein, 373 aa, Pratylenchus zeae
SAQIEVIPCKVCGDKSSGVHYGVITCEGCKGFFRRSQQGPTNYQCARQRNCVVDRVSRNRCQYCRLKKCMELGMSREAVKFGRMSKKQREKVEDEVRLHKQRSGEFAPNSSISTPPVMSASNGTHGQYQQAHFVSAPNSVGPSTPGSAGIDFKEFKYSPPNGPILVGTYGQPPQLFHPAAAAQQFHGSPGDEQFHLPLGGSQMANVGFGQPSCSSTSLLYAHQQLPHACAPISYSLPSGFGQQQQPVAQLGVVPSSSGGYPVPESVCQVQHVVSSTVDDELIKSVSRAYELTYVHYLPRRWDQQLELDAQQVERLRNMNRTDGWLKFAKELTEIIRCIIEFAKAIKGFQELKQDDQIQALKQTTFVLSLIAIA

SEQ ID NO: 98 - protein, 504 aa, Pratylenchus zeae
MMMMGNNDWSSRASQSQQQQQQQQQQPVETTAIPQYGVSPPICIKPPTERDLRLTRELDEYMQKCGLFESTADMQRRLEVLRRINAMVKKWVKEVSQEKVPPDQLETVGGKLFTFGSYRLGVHTPGADIDSLCVVPRHIDRTDFFASFYEKLKEDENTTDLHKVEDAFVPVIKLRYSGIDLDILFARLALKEVADDQQLTDDNLLRNLDEKSIRSLNGCRVADEILRLIPNHRNFIVTLRAVKLWAKNHGIYSNVLGFLGGVAWAILVARTCQLYPNAAPAVLLEKFFLVFSQWEWPHPVILKDADATPRVDMPYFVDMIWDPRTRVSDRYHLMPIITPAFPEQNSTFNVTKSTRQVMTNEFKEGLNTMIEITKGEAGWDKLFEEINFFTRYKHFIALLCVTADEEDHLIFSGLVESKIRHLVASLERNPCVALCHVNPRQYKPIDTKDLEIEYENPVCTLWFIGLEFMRDLQRSMNINLTEEIQAFVSNTVYLSASAMKDFKP

SEQ ID NO: 99 - protein, 352 aa, Pratylenchus zeae
MACNNLKLAIVRAESHLLGNRRKFSSALAATTPCIKLNRASCLSPQKAQQRRTIVDRKTLARLLPDNYPDPWPYKERSFTFNNIFFNSTMTRLHRNSRIIVVEGNIGSGKSEFAAQLAQELGFYHMPAFSMNEILVDRYGNDLRKFYHLFPKRYRTPDELMFYANPTDDNTAVMQDTIYQCRFDQHMNALAHIFNTGQGVVMERSVFSDFVFVNAMYEKGWISPEYFKYYHFARKVTLPKLDLHPHLYIYLNAPISKCLENIKKRGNANEIEHVDARYLKTIEESYKDFLREVKLGSYVLSYDWAQPEYMDIVLEDIFNLNMDTYEWHTMSDVLQPWHSIGEADFNYGWHRW

SEQ ID NO: 100 - protein, 325 aa, Pratylenchus zeae
MVSTSRRMKLVSIPTIFLFITITTVVRGPRVFEDALTTHDCKKFPIVATSSGCVDYTAKPFKVEAKDPKNPCLLYMESISVVLYNVKTKQSAWVVLNDSYSVAIKCPASNNIGAEFSVDLSADARDVPGYKIDEKNRVKENSVFTVNGFHIGLTFNFTQSAYWQLVDAKADQIKGDKMPNIDGNSKIVTGLPSAGKSAFLFKDSHAPDWNIAGFKDYGFACAHTKPIVWANEGDANYAVGVVFNNMQMSLNATYVDQESKAPLLRFSPKVSDCAPLFSIGTWMGLIVALLLIGVLSFGFLMLNSVQTMDRFDDPKQKQLVINAKE

SEQ ID NO: 101 - protein, 157 aa, Pratylenchus zeae
MIHYMLLFSRQGKLRLQKWYMAYPDKAKKKITRELITTILGRKPKMCAFLEYKELKVVYKRYASLYFCCAIEQSDNELLCLEIIHRYVELLDRYFGSVCELDIIFNFEKAYFILDEFLLAGEIQETSKKQVLKAISAQDLIMDEETTQGFFEDNGLG

SEQ ID NO: 102 - protein, 481 aa, Pratylenchus zeae
VSHREEDSMNQEPSMSGQQIVGLIIPPPDIRTIVDKTALFVARNGAEFENKIREREASNMRFNFLNPLDPYHAYYKNKVKEYETGVASAKLPEAVREHIQKAEFIPRNPPKPFEFSADPSTINAFDLDLIHLTALFVARNGRQFLTQLMNREVRNFQFDFLKPQHSNFQYFTKLVEQYTKVIIPPKNVVDELRNTGSHQKILEDIRYRVGWEKHQKAIKDREDAEVEQERMAYNQIDWHDFVVVQTVDFQPTETVNLPPLCTPKDVGARILLQQRTEAAKAAAESVAMDMESESEEEPEEEGQAEDLQHRLKISEKQHTGSAVTQPAPAAPTASNVVIRDYDPKKARAGTQSKSAEKFIISPLTNERVPADKLHEHVRYNTVDPQFKEQRDREQIERHDEDPITASGTEISRNIAKLAERRTDIFGIGEKGAEQTIIGKKLGEEERTMPRSDPKTIWDGQQATIDATTRAAQQSVSLEQQI

SEQ ID NO: 103 - DNA, 588 bp, Arabidopsis thaliana
ggtaccatcttctgtatcatcttcttcttcttcaaggtgagtctctagatccgttcgcttgattttgctgctcgttagtcgttattgttgattctctatgccgatttcgctagatccgtttagcatgcgttgtggttttatgagaaaatctttgttttgggggttgcttgttatgtgattcgatccgtgcttgttggatcgatctgagctaattcttaaggtttatgtgttagatcaatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattgatgtgttttctcgttgtgatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaggcgcgcc

SEQ ID NO: 104 - DNA, 1052 bp, Figwort Mosaic Virus
caatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatccgcattccagattgggttcaatcaacaaggtacgagccatatcactttattcaaattggtatcgccaaaaccaagaaggaactcccatcctcaaaggtttgtaaggaagaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattccctctatataagaaggcattcattcccatttgaaggacacagaaaaatttgctacattgtttcacaaacttcaaatattattcatttatttgtcagctttcaaactctttgtttcttgtttgttgattgagaataggtaccggcgcgcc

SEQ ID NO: 105 - DNA, 1064 bp, Cauliflower Mosaic Virus
caatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatcccacgtgcggaccgcctgcaggccgcgttatcaagctaactgcaggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcc

SEQ ID NO: 106 - DNA, 1156 bp, Cauliflower Mosaic Virus
caatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatcccacgtgcggaccgcctgcaggccgcgttatcaagctaactgcaggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattgagaataggtaccggcgcgcc

SEQ ID NO: 107 - DNA, 1462 bp, Artificial Sequence
  Description of Artificial Sequence: Synthetic polynucleotide
atagcgacatctatgatagagcgccacaataacaaacaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattacatttacaattaccgacgtc

SEQ ID NO: 108 - DNA, 405 bp, Artificial Sequence
  Description of Artificial Sequence: Synthetic polynucleotide
ggcgcgcctcagcagtcgctgtcgttaccgtattttccctcccggcgaacaattgattaccacatcttctggtcgtactctcttctttaaacaacccattttggggtgttctcctcgaccgcgaaaaagaagtactccgatcgcgttaacgctttatcacgataccttctaccacatatcactaacaacatcaacactcatcactctcgacgacatccactcgatcactactctcacacgaccgattaactcctcatccacgcggccgcctgcctttttcgcggtcgaggagaacaccccaaaatgggttgtttaaagaagagagtacgaccagaagatgtggtaatcaattgttcgccgggagggaaaatactagaacccagcggtactcgctgaggcgatcgc

SEQ ID NO: 109 - DNA, 405 bp, Artificial Sequence
  Description of Artificial Sequence: Synthetic polynucleotide
ggcgcgcctcagcagtcgctgtcgttacccattgcctggcgcaatgctttttgggtgtcctcatccttgggaattacaacccgttgatagttggccgcctcattttcgtccggcacttccgccgaaacgaagtactccgatcgcgttaacgctttatcacgataccttctaccacatatcactaacaacatcaacactcatcactctcgacgacatccactcgatcactactctcacacgaccgattaactcctcatccacgcggccgcctgccgtttcggcggaagtgccggacgaaaatgaggcggccaactatcaacgggttgtaattcccaaggatgaggacacccaaaaagcattgcgccaggcaatgtagaacccagcggtactcgctgaggcgatcgc

SEQ ID NO: 110 - DNA, 405 bp, Artificial Sequence
  Description of Artificial Sequence: Synthetic polynucleotide
ggcgcgcctcagcagtcgctgtcgttacccatagaattgagtgatcccaatcagagtcaattcctccatcaaattgatttcatatggtctttgcatacgcttgctcatgaagagggccaccgtctttggaagtactccgatcgcgttaacgctttatcacgataccttctaccacatatcactaacaacatcaacactcatcactctcgacgacatccactcgatcactactctcacacgaccgattaactcctcatccacgcggccgcctgcccaaagacggtggccctcttcatgagcaagcgtatgcaaagaccatatgaaatcaatttgatggaggaattgactctgattggaatcactcaattctatgtagaacccagcggtactcgctgaggcgatcgc

SEQ ID NO: 111 - DNA, 405 bp, Artificial Sequence
  Description of Artificial Sequence: Synthetic polynucleotide
ggcgcgcctcagcagtcgctgtcgttacctaccattgccatttgggcagcctgattgctcaaatatccactgccctcctcaacgcccatcgccgctcgaaccaaattcacattccattggcatttcaataagtactccgatcgcgttaacgctttatcacgataccttctaccacatatcactaacaacatcaacactcatcactctcgacgacatccactcgatcactactctcacacgaccgattaactcctcatccacgcggccgcctgcattgaaatgccaatggaatgtgaatttggttcgagcggcgatgggcgttgaggagggcagtggatatttgagcaatcaggctgcccaaatggcaatggtatagaacccagcggtactcgctgaggcgatcgc

SEQ ID NO: 112 - DNA, 607 bp, Artificial Sequence
  Description of Artificial Sequence: Synthetic polynucleotide
ggcgcgcctcagcagtcgctgtcgttaccccatttccttccacttgtgcccttttggcggtggtattttcactcccggcgaacaattgattaccacatcttctggtcgtactctcttctttaaacaacccattttggggtgttctcctcgaccgcgaaaaagaccgggtggttcaattcgaaaattgccaattttctgtttatacccgtccagcgatgcataaccgtattaagtactccgatcgcgttaacgctttatcacgataccttctaccacatatcactaacaacatcaacactcatcactctcgacgacatccactcgatcactactctcacacgaccgattaactcctcatccacgcggccgcctgcaatacggttatgcatcgctggacgggtataaacagaaaattggcaattttcgaattgaaccacccggtctttttcgcggtcgaggagaacaccccaaaatgggttgtttaaagaagagagtacgaccagaagatgtggtaatcaattgttcgccgggagtgaaaataccaccgccaaaagggcacaagtggaaggaaatggtagaacccagcggtactcgctgaggcgatcgc

SEQ ID NO: 113 - DNA, 609 bp, Artificial Sequence
  Description of Artificial Sequence: Synthetic polynucleotide
ggcgcgcctcagcagtcgctgtcgttacctcctcatccaaatccaaatgggcaaacagaacatttttgcacattgcctggcgcaatgctttttgggtgtcctcatccttgggaattacaacccgttgatagttggccgcctcattttcgtccggcacttccgccgaaacgcccagccgcctgcgatttccttggggcaaacgtggtggctcctccaacgtgtcatcatcataagtactccgatcgcgttaacgctttatcacgataccttctaccacatatcactaacaacatcaacactcatcactctcgacgacatccactcgatcactactctcacacgaccgattaactcctcatccacgcggccgcctgcatgatgatgacacgttggaggagccaccacgtttgccccaaggaaatcgcaggcggctgggcgtttcggcggaagtgccggacgaaaatgaggcggccaactatcaacgggttgtaattcccaaggatgaggacacccaaaaagcattgcgccaggcaatgtgcaaaaatgttctgtttgcccatttggatttggatgaggatagaacccagcggtactcgctgaggcgatcgc

SEQ ID NO: 114 - DNA, 819 bp, Artificial Sequence
  Description of Artificial Sequence: Synthetic polynucleotide
ggcgcgcctcagcagtcgctgtcgttacctgatttgacgatcaccaggcaggaaattgaccaaacgatccaggactccttggaaatcttgcgaaagcaatttgtcggcctcatcgagcacgatggtcttgcattgagaaacattggcaacacctttctccatgagatcaagaattcgacccggagtagcaacaaccaaatggacgatcccattgagacgcaaaatatcatcacgaaggtcggtgccaccagtggtaaccataatcttgattttgagatgtttgctcaattccacgcagatttgagaagtttgtaaagccaattcgcgggttggaacaagtactccgatcgcgttaacgctttatcacgataccttctaccacatatcactaacaacatcaacactcatcactctcgacgacatccactcgatcactactctcacacgaccgattaactcctcatccacgcggccgcctgcgttccaacccgcgaattggctttacaaacttctcaaatctgcgtggaattgagcaaacatctcaaaatcaagattatggttaccactggtggcaccgaccttcgtgatgatattttgcgtctcaatgggatcgtccatttggttgttgctactccgggtcgaattcttgatctcatggagaaaggtgttgccaatgtttctcaatgcaagaccatcgtgctcgatgaggccgacaaattgctttcgcaagatttccaaggagtcctggatcgtttggtcaatttcctgcctggtgatcgtcaaatcatagaacccagcggtactcgctgaggcgatcgc

SEQ ID NO: 115 - DNA, 705 bp, Artificial Sequence
  Description of Artificial Sequence: Synthetic polynucleotide
ggcgcgcctcagcagtcgctgtcgttaccgcaaacgtggtggctcctccagcgtgtcatcctcgtccggcacattatgcacagtttcctgtgaaaattgttgacgttgctgttcggcggcaatacgatcgaaatggtcccgcaagaacagaacagggttgtccggtttgtggatgcacagcgaaacgatggcatccttcaccaattgttgaatgttatgttggcgaacatatgcctggcatgaggcaagttgggcctcttccgcactttgtgccgacataagtactccgatcgcgttaacgctttatcacgataccttctaccacatatcactaacaacatcaacactcatcactctcgacgacatccactcgatcactactctcacacgaccgattaactcctcatccacgcggccgcctgcatgtcggcacaaagtgcggaagaggcccaacttgcctcatgccaggcatatgttcgccaacataacattcaacaattggtgaaggatgccatcgtttcgctgtgcatccacaaaccggacaaccctgttctgttcttgcgggaccatttcgatcgtattgccgccgaacagcaacgtcaacaattttcacaggaaactgtgcataatgtgccggacgaggatgacacgctggaggagccaccacgtttgctagaacccagcggtactcgctgaggcgatcgc

SEQ ID NO: 116 - DNA, 1045 bp, Artificial Sequence
  Description of Artificial Sequence: Synthetic polynucleotide
ggcgcgcctcagcagtcgctgtcgttacctgtattctttggatgaatcaatcttttcgatgcaaggaatgcagtatgcgccagttttacccgttccattctttgctcgtgcaagtatatcttgtcctgagagtgtatgttccttggatgaatcgatcttctcaatgcagggaatgcaatatgcgccagttttacccgtgccattctttgcgcgcgcaagtatgtcctggcccgagagtgcgttctccttggacgtatcaatcttttctatgcacggaatgcagtatgcacccgtcttgccggtcccgttctttgctcgcgccaaaatgtcttgtcctgatagcgtgtattctttcgttggatcaattttctcaatgcaaggaatgcaatatgcgccagttttacccgttccatttttggctcgtgcgagaatatcttgtcctgagagtgaagtactccgatcgcgttaacgctttatcacgataccttctaccacatatcactaacaacatcaacactcatcactctcgacgacatccactcgatcactactctcacacgaccgattaactcctcatccacgcggccgcctgccactctcaggacaagatattctcgcacgagccaaaaatggaacgggtaaaactggcgcatattgcattccttgcattgagaaaattgatccaacgaaagaatacacgctatcaggacaagacattttggcgcgagcaaagaacgggaccggcaagacgggtgcatactgcattccgtgcatagaaaagattgatacgtccaaggagaacgcactctcgggccaggacatacttgcgcgcgcaaagaatggcacgggtaaaactggcgcatattgcattccctgcattgagaagatcgattcatccaaggaacatacactctcaggacaagatatacttgcacgagcaaagaatggaacgggtaaaactggcgcatactgcattccttgcatcgaaaagattgattcatccaaagaatacatagaacccagcggtactcgctgaggcgatcgc

SEQ ID NO: 117 - DNA, 1045 bp, Artificial Sequence
  Description of Artificial Sequence: Synthetic polynucleotide
ggcgcgcctcagcagtcgctgtcgttacccagaacatattccccattcacaaaaacatccacttccccattgtcgatcacgtagaaattgtcgccttcttcgccctgttcaatgattgtttcgcccttcgatttcagcacatattccccattcacgaacacatcaacctcgccgctgtcgatcacgtagaaattctcgccttcctcgccctgttctatgattgtctcccccttctgcttcagcacgtactcgccattcacgaacacgtcaacttcgccgctgtcgatcacgtagaagttgtcgccttcttcgccctgttcaatgattgtctcgccctggtgtttcaatacaaattccccgttgacgaatacgtccacttcgccattgtcgatcacgtagaaattgtcgccttcttcgccctgttcaatgattgtctcgccttttggcttaagtactccgatcgcgttaacgctttatcacgataccttctaccacatatcactaacaacatcaacactcatcactctcgacgacatccactcgatcactactctcacacgaccgattaactcctcatccacgcggccgcctgcaagccaaaaggcgagacaatcattgaacagggcgaagaaggcgacaatttctacgtgatcgacaatggcgaagtggacgtattcgtcaacggggaatttgtattgaaacaccagggcgagacaatcattgaacagggcgaagaaggcgacaacttctacgtgatcgacagcggcgaagttgacgtgttcgtgaatggcgagtacgtgctgaagcagaagggggagacaatcatagaacagggcgaggaaggcgagaatttctacgtgatcgacagcggcgaggttgatgtgttcgtgaatggggaatatgtgctgaaatcgaagggcgaaacaatcattgaacagggcgaagaaggcgacaatttctacgtgatcgacaatggggaagtggatgtttttgtgaatggggaatatgttctgtagaacccagcggtactcgctgaggcgatcgc

SEQ ID NO: 118 - DNA, 1045 bp, Artificial Sequence
  Description of Artificial Sequence: Synthetic polynucleotide
ggcgcgcctcagcagtcgctgtcgttaccatcattggcatttgtcaattgatccaattgttcttgcaaagtaatggatgcattgtaagtacggaacacctttgctgtcagcccatccattagttctttcaaataatcctcagcatttgtcagtttgtcaagctgttcttgcaaagttatggacgcattgtaagtacgaaaaactttggctgtaagcccatccattagttctttcagatagtcatcaggattggttagtttatccagttgttcctgcaatgtgattgatgcgttgtatgtgcggaacacttttgctgtcaatccttccatcaattccttcagataatcatcgggatttgtgagtttgtccaattgttcctgcaatgtgatggatgcattgtaggtacgaaaaacttttgcggtcaatccatccatcaattctttcaaataaagtactccgatcgcgttaacgctttatcacgataccttctaccacatatcactaacaacatcaacactcatcactctcgacgacatccactcgatcactactctcacacgaccgattaactcctcatccacgcggccgcctgctatttgaaagaattgatggatggattgaccgcaaaagtttttcgtacctacaatgcatccatcacattgcaggaacaattggacaaactcacaaatcccgatgattatctgaaggaattgatggaaggattgacagcaaaagtgttccgcacatacaacgcatcaatcacattgcaggaacaactggataaactaaccaatcctgatgactatctgaaagaactaatggatgggcttacagccaaagtttttcgtacttacaatgcgtccataactttgcaagaacagcttgacaaactgacaaatgctgaggattatttgaaagaactaatggatgggctgacagcaaaggtgttccgtacttacaatgcatccattactttgcaagaacaattggatcaattgacaaatgccaatgattagaacccagcggtactcgctgaggcgatcgc

SEQ ID NO: 119 - DNA, 1717 bp, Artificial Sequence
  Description of Artificial Sequence: Synthetic polynucleotide
ggcgcgcctcagcagtcgctgtcgttaccaatggatgcattgtaagtacggaacacctttgctgtcagcccatccattagttctttcaaatatatggacgcattgtaagtacgaaaaactttggctgtaagcccatccattagttctttcagatagattgatgcgttgtatgtgcggaacacttttgctgtcaatccttccatcaattccttcagatagatggatgcattgtaggtacgaaaaacttttgcggtcaatccatccatcaattctttcaaatagtcgatcacgtagaaattgtcgccttcttcgccctgttcaatgattgtttcgcccttcgatttgtcgatcacgtagaaattctcgccttcctcgccctgttctatgattgtctcccccttctgcttgtcgatcacgtagaagttgtcgccttcttcgccctgttcaatgattgtctcgccctggtgtttgtcgatcacgtagaaattgtcgccttcttcgccctgttcaatgattgtctcgccttttggcttagtatgcgccagttttacccgttccattctttgctcgtgcaagtatatcttgtcctgagagtgaatatgcgccagttttacccgtgccattctttgcgcgcgcaagtatgtcctggcccgagagtgagtatgcacccgtcttgccggtcccgttctttgctcgcgccaaaatgtcttgtcctgatagcgaatatgcgccagttttacccgttccatttttggctcgtgcgagaatatcttgtcctgagagtgaagtactccgatcgcgttaacgctttatcacgataccttctaccacatatcactaacaacatcaacactcatcactctcgacgacatccactcgatcactactctcacacgaccgattaactcctcatccacgcggccgcctgccactctcaggacaagatattctcgcacgagccaaaaatggaacgggtaaaactggcgcatattcgctatcaggacaagacattttggcgcgagcaaagaacgggaccggcaagacgggtgcatactcactctcgggccaggacatacttgcgcgcgcaaagaatggcacgggtaaaactggcgcatattcactctcaggacaagatatacttgcacgagcaaagaatggaacgggtaaaactggcgcatactaagccaaaaggcgagacaatcattgaacagggcgaagaaggcgacaatttctacgtgatcgacaaacaccagggcgagacaatcattgaacagggcgaagaaggcgacaacttctacgtgatcgacaagcagaagggggagacaatcatagaacagggcgaggaaggcgagaatttctacgtgatcgacaaatcgaagggcgaaacaatcattgaacagggcgaagaaggcgacaatttctacgtgatcgactatttgaaagaattgatggatggattgaccgcaaaagtttttcgtacctacaatgcatccatctatctgaaggaattgatggaaggattgacagcaaaagtgttccgcacatacaacgcatcaatctatctgaaagaactaatggatgggcttacagccaaagtttttcgtacttacaatgcgtccatatatttgaaagaactaatggatgggctgacagcaaaggtgttccgtacttacaatgcatccatttagaacccagcggtactcgctgaggcgatcgc

SEQ ID NO: 120 - DNA, 2517 bp, Artificial Sequence
  Description of Artificial Sequence: Synthetic polynucleotide
  modified_base (10)..(12): a, c, t, g, unknown or other
  modified_base (16)..(16): a, c, t, g, unknown or other
  modified_base (25)..(25): a, c, t, g, unknown or other
  modified_base (30)..(30): a, c, t, g, unknown or other
  modified_base (33)..(33): a, c, t, g, unknown or other
  modified_base (40)..(40): a, c, t, g, unknown or other
  modified_base (111)..(111): a, c, t, g, unknown or other
  modified_base (144)..(144): a, c, t, g, unknown or other
  modified_base (168)..(168): a, c, t, g, unknown or other
  modified_base (198)..(198): a, c, t, g, unknown or other
  modified_base (228)..(229): a, c, t, g, unknown or other
  modified_base (236)..(237): a, c, t, g, unknown or other
  modified_base (239)..(239): a, c, t, g, unknown or other
  modified_base (270)..(270): a, c, t, g, unknown or other
  modified_base (281)..(281): a, c, t, g, unknown or other
  modified_base (294)..(294): a, c, t, g, unknown or other
  modified_base (297)..(297): a, c, t, g, unknown or other
  modified_base (300)..(300): a, c, t, g, unknown or other
  modified_base (327)..(328): a, c, t, g, unknown or other
  modified_base (333)..(333): a, c, t, g, unknown or other
  modified_base (339)..(339): a, c, t, g, unknown or other
  modified_base (354)..(354): a, c, t, g, unknown or other
  modified_base (378)..(378): a, c, t, g, unknown or other
  modified_base (396)..(396): a, c, t, g, unknown or other
  modified_base (435)..(435): a, c, t, g, unknown or other
  modified_base (468)..(468): a, c, t, g, unknown or other
  modified_base (508)..(508): a, c, t, g, unknown or other
  modified_base (510)..(510): a, c, t, g, unknown or other
  modified_base (522)..(522): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (542)..(543): a, c, t, g, unknown or other
  modified_base (547)..(547): a, c, t, g, unknown or other
  modified_base (555)..(555): a, c, t, g, unknown or other
  modified_base (561)..(561): a, c, t, g, unknown or other
  modified_base (564)..(565): a, c, t, g, unknown or other
  modified_base (576)..(576): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (591)..(591): a, c, t, g, unknown or other
  modified_base (597)..(598): a, c, t, g, unknown or other
  modified_base (609)..(609): a, c, t, g, unknown or other
  modified_base (612)..(612): a, c, t, g, unknown or other
  modified_base (616)..(616): a, c, t, g, unknown or other
  modified_base (625)..(625): a, c, t, g, unknown or other
  modified_base (630)..(630): a, c, t, g, unknown or other
  modified_base (639)..(639): a, c, t, g, unknown or other
  modified_base (641)..(642): a, c, t, g, unknown or other
  modified_base (648)..(648): a, c, t, g, unknown or other
  modified_base (651)..(651): a, c, t, g, unknown or other
  modified_base (654)..(657): a, c, t, g, unknown or other
  modified_base (663)..(663): a, c, t, g, unknown or other
  modified_base (666)..(668): a, c, t, g, unknown or other
  modified_base (670)..(671): a, c, t, g, unknown or other
  modified_base (673)..(675): a, c, t, g, unknown or other
  modified_base (679)..(679): a, c, t, g, unknown or other
  modified_base (681)..(681): a, c, t, g, unknown or other
  modified_base (685)..(685): a, c, t, g, unknown or other
  modified_base (690)..(690): a, c, t, g, unknown or other
  modified_base (692)..(693): a, c, t, g, unknown or other
  modified_base (695)..(695): a, c, t, g, unknown or other
  modified_base (697)..(699): a, c, t, g, unknown or other
  modified_base (705)..(705): a, c, t, g, unknown or other
  modified_base (883)..(885): a, c, t, g, unknown or other
  modified_base (999)..(999): a, c, t, g, unknown or other
  modified_base (1186)..(1186): a, c, t, g, unknown or other
  modified_base (1204)..(1204): a, c, t, g, unknown or other
  modified_base (1206)..(1206): a, c, t, g, unknown or other
  modified_base (1242)..(1242): a, c, t, g, unknown or other
  modified_base (1260)..(1260): a, c, t, g, unknown or other
  modified_base (1272)..(1272): a, c, t, g, unknown or other
  modified_base (1305)..(1305): a, c, t, g, unknown or other
  modified_base (1368)..(1368): a, c, t, g, unknown or other
  modified_base (1377)..(1377): a, c, t, g, unknown or other
  modified_base (1404)..(1404): a, c, t, g, unknown or other
  modified_base (1465)..(1465): a, c, t, g, unknown or other
  modified_base (1467)..(1467): a, c, t, g, unknown or other
  modified_base (1503)..(1503): a, c, t, g, unknown or other
  modified_base (1522)..(1524): a, c, t, g, unknown or other
  modified_base (1666)..(1668): a, c, t, g, unknown or other
  modified_base (1779)..(1779): a, c, t, g, unknown or other
  modified_base (1932)..(1932): a, c, t, g, unknown or other
  modified_base (1950)..(1950): a, c, t, g, unknown or other
  modified_base (1953)..(1953): a, c, t, g, unknown or other
  modified_base (1962)..(1962): a, c, t, g, unknown or other
  modified_base (1975)..(1975): a, c, t, g, unknown or other
  modified_base (2016)..(2016): a, c, t, g, unknown or other
  modified_base (2272)..(2517): a, c, t, g, unknown or other
atggcgtggnnnaatnaaggaatgnaagcnctnattccgntcatcaacaaaatacaggacgcttttgcccaacttggcatgccgctgaacttggatttgccgcaaatcgcngtggttggaagtcaaagtgcaggaaaatcgtcngttcttgagagttttgttggaaangactttttgccgcgtggaagtggaattgtnacccggcgtccactcatcctccaacttacnnatgaccnnanagaatacgccgaatttctgcacaagaagggngaaaaattcancgactttgacgangtncgnaaagagattgaagaggaaacggaccgnntcacnggtgcnaacaaaggcatctcnccagttcccataaatcttcgcatnttcagtcctaaagttgtnaatctcactctgattgatctccctggattgacaaaagtnccggttggtgaccaaccgcaagacattgagaancaaatccgagacatgattctcaccttcatctcgcgcgagncntgcctgatcctngcngtcacnccggcnaacanngatntggccacntcggangcnntcaaattggcncgngangttganccncaaggnntgcgcacaatnggngtgntgaccaagntgganttgatggangnnggcacngangcnnnngacatnctnnngnncnnnttgntnccgntcagncnngncnnnattggngtgatcaaccgcagccaaaaggatattgtcggccgaaaagacattcgcgcagcattggacgctgaacgcaaattcttcttgtcgcatccttcctacagacacatggctgaccgaatgggcactccttacctgcagaagacactgaatcaacaactgaccaaccacattaaagacaccnnnccaacattgcgtgacagtttgcagaagaagctttactccatggaaaaggaggtgcaagagtacaagaacttccaattcaacgatccttcgcgcaagacaaaagcgttgatgaanatggttcaacaattcaccgctgacatggaacgctccattgaaggctcttcagcaagactggtttccaccaacgagctctccggcggtgcccgcatcaatcgcctcttccatgagcgctttccatttgaaattgtgaaaatgaccattgatgagaaggaaatgcgacgcgaaattcaatttgcaattnggaacatccacggcatcngngttggtcttttcacaccggacatggcttttgaggcnattgtgaagaaacaaatngaacgactgaangaaccctcgctgaaatgcgttgatttggtggtnaacgagttggccaatgtggtccgtgggtgtgcagaatgtgttggccgctatccacgactgcgngattgtgtngaacaaattgtgaccaacaacatgcgncaacaagaagcatttgccaagcagcaaatctcaatgctggtggactatgaattggcttacntnaacacaaaccatgaagattttattggcttttcaaangccgaagcaaaagcctcannntcgacaagtacaaagaagaatttgggcaatcaagtgatccgcaaaggctggctttctgtgcacaacatcagttttgtgcgaggctcacgcgaatgctggtttgtgctcacgtcggagagtctttcttggtttaaagatgacnnngaaaaagagaagaaatacatgcttccactggatggcatcaaactgaaggacttagaagctggctttatgtcaaggcaacacaaatttgcgctcttctaccccgacggaaanaatatctacaaggactacaaggaattggagctgagcgccaaaaatttggacgatgtcgaggcgtggaaagcttctttcttgcgcgccggtgtttacccagaaaagcaaccggtttcggatgagaatggagagaccgctgaggtggcaagcagnatggatcccgcgttggancgncaagtgganaccatccgcaacntggtcgactcctacatgcgcatcatcaccaaaacaatccgngatttggtgccgaaagcaatcatgcatttgatcgtcaataagatggctgactttctacgcgatgaactcttggcaagcctttaccaacatggcggcgacacacaattgatggaggaatcgccgctggaagcacagaaaagggaagaaattctgcgcatgtaccactcctgcaaagaggcactgcgcatcatcaacgacgtgaacatgagcacaatcacgacggacattccgccctcggtggtgaatgattggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 121 - DNA, 1422 bp, Artificial Sequence
  Description of Artificial Sequence: Synthetic polynucleotide
  modified_base (1)..(3): a, c, t, g, unknown or other
  modified_base (156)..(156): a, c, t, g, unknown or other
  modified_base (354)..(354): a, c, t, g, unknown or other
  modified_base (1308)..(1308): a, c, t, g, unknown or other
  modified_base (1420)..(1422): a, c, t, g, unknown or other
nnntcagtaaaatttctggaatttgtgaagccattctgcggcttcgtgcccgaggtctcaaagcccgagaggaaaattcaattccgggagaagatgctctggacggccatcacattgttcgtcttcctcgtctgttgtcaaattcccctattcgcnataatgtccacagacagcgcagaccctctctattggcttcgagtgatcatggcctcgaacaggggaactctcatggaattgggcatctcgcccattgtcacatctggcttgataatgcaactcttggccggcgcaaagatcatcgaagttggggacacgccaaaggaaagggcgctcttcaatggggcacagaaaccnttcggaatggtcatcacaatcggccaggcaattgtctatgtcgcatccggaatgtacggaaatccacatgagattggcgctggcatttgcctgctcatcgtcatccaactggtcattgctggattgattgtgctgttgttggacgaattgcttcagaaaggttatggcctcggctctggcatttccctgttcattgccaccaacatttgcgaaacgatcgtctggaaagccttttcgccggccacaatgaacaccgggcgcggcactgaattcgaaggtgcaatcatcgccctcttccacctgctggccacccggaatgacaaagtgcgtgcgctgcgcgaggctttctaccgccagaacttgcccaatctgatgaacttgcttgccaccgtcctggtctttgctgtggtcatctacttccaagggttccgcgtcgacttgcccatcaaaagtgcccgctaccgtggccagcacagctcctacccaatcaagctgttctacaccagcaacatcccaatcatcctgcaatctgcgctggtctccaacctgtacgtcatctcccaaatgctggcaaccaaattcggcggcaacattctggtcaacctgctcggccagtggtccgactcaaccggctaccgcagctatccaaccggcggcctctgctactacctgtcaccaccggagtcactctcgcacatcctggaggacccaatccactgcatcatctacattgtcttcatgctcggctcgtgcgccttcttctccaaaacatggattgatgtgagcggctccagcgccaaggacgtggccaagcagttgaaggaacaacaaatgatcatgcgcggccatcgcgagaagtccatgatccacgaactgaaccgatacatcccaaccgcagcagcattcggcggactttgcattggcgcattgtctgtcacggcggacttcttggangccattggaagcgggactggaatattgctggctgtcaccatcatctatcagtatttcgagatattcgtcaaggaacaacaagagatgggcggaatttcgggcctcttcttcnnn

SEQ ID NO: 122 - DNA, 3087 bp, Artificial Sequence
  Description of Artificial Sequence: Synthetic polynucleotide
  modified_base (1)..(51): a, c, t, g, unknown or other
  modified_base (76)..(78): a, c, t, g, unknown or other
  modified_base (80)..(80): a, c, t, g, unknown or other
  modified_base (112)..(112): a, c, t, g, unknown or other
  modified_base (162)..(162): a, c, t, g, unknown or other
  modified_base (165)..(165): a, c, t, g, unknown or other
  modified_base (186)..(186): a, c, t, g, unknown or other
  modified_base (233)..(233): a, c, t, g, unknown or other
  modified_base (262)..(262): a, c, t, g, unknown or other
  modified_base (264)..(264): a, c, t, g, unknown or other
  modified_base (268)..(268): a, c, t, g, unknown or other
  modified_base (276)..(277): a, c, t, g, unknown or other
  modified_base (285)..(286): a, c, t, g, unknown or other
  modified_base (289)..(293): a, c, t, g, unknown or other
  modified_base (301)..(303): a, c, t, g, unknown or other
  modified_base (307)..(307): a, c, t, g, unknown or other
  modified_base (315)..(315): a, c, t, g, unknown or other
  modified_base (327)..(327): a, c, t, g, unknown or other
  modified_base (336)..(336): a, c, t, g, unknown or other
  modified_base (340)..(340): a, c, t, g, unknown or other
  modified_base (347)..(347): a, c, t, g, unknown or other
  modified_base (360)..(360): a, c, t, g, unknown or other
  modified_base (381)..(381): a, c, t, g, unknown or other
  modified_base (385)..(385): a, c, t, g, unknown or other
  modified_base (387)..(387): a, c, t, g, unknown or other
  modified_base (412)..(414): a, c, t, g, unknown or other
  modified_base (664)..(666): a, c, t, g, unknown or other
  modified_base (712)..(712): a, c, t, g, unknown or other
  modified_base (714)..(725): a, c, t, g, unknown or other
  modified_base (729)..(737): a, c, t, g, unknown or other
  modified_base (740)..(742): a, c, t, g, unknown or other
  modified_base (745)..(748): a, c, t, g, unknown or other
  modified_base (750)..(752): a, c, t, g, unknown or other
  modified_base (754)..(759): a, c, t, g, unknown or other
  modified_base (763)..(764): a, c, t, g, unknown or other
  modified_base (767)..(767): a, c, t, g, unknown or other
  modified_base (769)..(770): a, c, t, g, unknown or other
  modified_base (891)..(891): a, c, t, g, unknown or other
  modified_base (898)..(898): a, c, t, g, unknown or other
  modified_base (905)..(905): a, c, t, g, unknown or other
  modified_base (931)..(1017): a, c, t, g, unknown or other
  modified_base (1155)..(1155): a, c, t, g, unknown or other
  modified_base (1167)..(1167): a, c, t, g, unknown or other
  modified_base (1191)..(1191): a, c, t, g, unknown or other
  modified_base (1301)..(1301): a, c, t, g, unknown or other
  modified_base (1320)..(1320): a, c, t, g, unknown or other
  modified_base (1437)..(1437): a, c, t, g, unknown or other
  modified_base (1440)..(1440): a, c, t, g, unknown or other
  modified_base (1452)..(1452): a, c, t, g, unknown or other
  modified_base (1468)..(1469): a, c, t, g, unknown or other
  modified_base (1471)..(1471): a, c, t, g, unknown or other
  modified_base (1473)..(1473): a, c, t, g, unknown or other
  modified_base (1476)..(1478): a, c, t, g, unknown or other
  modified_base (1635)..(1635): a, c, t, g, unknown or other
  modified_base (1749)..(1749): a, c, t, g, unknown or other
  modified_base (1861)..(1947): a, c, t, g, unknown or other
  modified_base (2587)..(2589): a, c, t, g, unknown or other
  modified_base (2701)..(2772): a, c, t, g, unknown or other
  modified_base (2860)..(2862): a, c, t, g, unknown or other
  modified_base (2955)..(2955): a, c, t, g, unknown or other
  modified_base (3085)..(3087): a, c, t, g, unknown or other
nnnnnnnnnnnnnnnnnnnnnnnnnnnnnnnnnnnnnnnnnnnnnnnnnnngttgacactaatctctactcgcgtnnnanttacgccttgggagagtcggcgatggctcatntgcgcaaagcttcggttctggttagcggtcttggctcagttggagttganatngccaagaatctcatactcgcnggagttcgtcatgtcacacttcacgaccaaaaggatttgacttacanggacttgtctgcccatttctacgcaagcnangctnatgtgggnnacaaccgnnttnnnnnttgcgccnnncagntggccganctgaacgacacngtcaactgngcgntctcaanggatgcactcacngaggagtttgtcaagcaattngatntnatcgtccttactgactcacctgagnnnctgcaaattcaggtcaatgattggatgcgcaaacacgggaaaatgttcatttcggctgatgcacgcggcctcttctcctatgcattcgtggacttgggcgatcaatttgctgtcactgacccggatggagaggcttgcaaagaggtcttgcttgagcacatcaattgtgagacgggtgagatattcacactggagggaatttaccacggactagaggatggtgatcacattgtgttcgaggactttgagnnncagcaggaactcaacgaactgaacccgattccaatcaagactactncnnnnnnnnnnnnaaannnnnnnnnttnnnaannnnannntnnnnnntttnnagngnncggacgtgcaaagcaagttaaagtgccgaagaatgttgcgttcaagtcgttggccgaagcactcaaggaaccggaaatcctcatttgggactttgcaaagtttgatgagcccgctcaactncacttcntatggcnagcgctctaccagttcgagaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtttcaaattattcacgttttaggcaactggaaacctgcagcccatcgcttcagtcattggcggttttgtggcccaagaagcgatgaaagcagttactcaccacacaactccattgaagcagtttctctacacngactcgttggangcgcttcctggcgactattcccantttgatgcggcaaaattgacaccgaaagattgtgcaccgcgcaaaagtcgctacgatggacaggccgccgtctttggttgggcattccaagaggcgctggaacaacaacnctggttcattgttggcgcnggcgcaattggctgtgagctgctgaagaacatggcaatgatgggactggcttgcggagaaaagggccaattgacaatcactgacccggacacaatcgaagtttccaacctgaaccgncanttcctctttcgncgaccggatgttgggnngngnaannntgaagtggcggcccgagcaattacgggattcaacgcagccgtgaagatccgcgcactgtccgacattgtttccgaggccaccgagaatgtgttcaacgacgacttcttcctcgacctgcatggagtgtgcaatgccctggacaatgtggaagcactncgttacgtggatcgtcgttgcgtctactaccagctgccgctgctcgagtcgggaacaatgggcaccaagggcaacacacaagtgatcttcccacatctgaccgaatcttacagntcatcgaatgatccgccggagaaggagacgcccgtttgcacgctcaagaacttcccataccagattcagcataccatccagtgggctcgttcggtgagtcttgcattttatnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgaagttttgcgcgcattgaacaaggccctcattgatgagtgcccaaagagtgcggaggattgtgtcaactgggcccgagagttgtttgaccagcagtaccggaatgaaatcatgcaactgcttcacaacttcccagctgatcaggtcacttcccaaggcgtcagattctggtctggcacaaagcgttgcccgcgtccgctgaccttcaacgtcaacaatgatgaacatttgcaattcatctacgcggcctccatccttcgtgcgcaactttacaaccttcagccaatcactgatcgtgcccgtgttgctcaacttgctgctgcttttcagtccaaaccgttccaacccaaggaaggagttcgaattgctgtcactgacgcggaggcggcaaatcaggcggagggtggcgaaccagatcaattagatgatgttgagcgccgcgtggacgatttgagtgttcgtttggcccgtcttcgccttgagcaattccagcgactgaacccaattgactttgagaaggacgacgacaccaaccatcacgtggacttcataaccgctgcttcgaaccttcgcgccgacaattactcgattgagaaggctgatcgcatgaagactaaacaaattgccggcaagatcnnncccgctttggccacaaccaccgcagttgtctcgggccttgtgtgcattgaactctacaaaaccatcgaggctgacggtctgtcgaatgcgcccattgaacgctacaaaaatnnnnnnnnnnnnnnnnnnnnnnnnnnnnnnnnnnnnnnnnnnnnnnnnnnnnnnnnnnnnnnnnnnnnnnnngatcgtgaatttacgctttgggatcgtctggaagtgaatggtccgaaaacaatgggacaactgatcgattggattgagacggaaaccnnnggcctcaccgtgtcaatgatgtcttccggcgtctcactgctttttgcgttcttccaaccgccagcaaaggtgcaggaacgccgcgcaagaganattcttgccgttgtggaggaagtttcgcgcaatccagtgccggactatcgtcgcgccattgtactcgaagcgatcacaaacaatgaacaggatgaagacgtggaaatcccctacatcaagtacaacttcnnn

SEQ ID NO: 123 - DNA, 1131 bp, Artificial Sequence
  Description of Artificial Sequence: Synthetic polynucleotide
  modified_base (1)..(219): a, c, t, g, unknown or other
  modified_base (843)..(843): a, c, t, g, unknown or other
  modified_base (960)..(960): a, c, t, g, unknown or other
  modified_base (1053)..(1053): a, c, t, g, unknown or other
  modified_base (1129)..(1131): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgttcccgacgaggacgacaccctggaagagccgccacggctgccccaaggccgtcggctgggcgtttccgcggagccggacgagaatgaggcggccaactaccagcgggtggtgatccccaaggacgaggacacccagaaggcgttgcgccaggcaatgtgcaagaatgtgctttttgcgcacttggatttggacgagcagaaggcaatcttcgacgcgatgttcccggtggagaaacaccagggcgagacaatcattgaacagggcgaagaaggcgacaacttctacgtgatcgacagcggcgaagtcgacgtgttcgtgaatggcgagtacgtgctgtccatcaaggagggcggctcctttggcgagttggcgctcatctatggcacaccccgtgccgcaacggttgtggccaagacggatgtcaaactgtgggccattgaccgcctcacctaccgggccatcctgatgggctccacaatgcgcaagcggaagatgtacgatgagttcctctccaaagtgtccatcctggccgaccttgacaagtgggagcgggccaatgttgccgacgcgctggagcagtgccaattcgagcagggaacacatgtggtggagcaagcncaacccggcgatgaattcttcatcatcgttgacggtgaagccgatgttctgcagagacctaacgaggaggcagcctttgaagtggttggcaacttggggccatctgactactttgcngaaatcgcccttctcctggaccgtccccgtgcggccactgttgttgccaaaacgccgttgaagtgcgtcaagttggaccgaaacagattcagncgtgtcatgggcccagtgcgcgagatcctcaagcgtgacgtgagccactacaacagctacgtgaagttgatgaccnnn

SEQ ID NO: 124 - DNA, 10275 bp, Artificial Sequence
  Description of Artificial Sequence: Synthetic polynucleotide
  modified_base (1)..(96): a, c, t, g, unknown or other
  modified_base (151)..(151): a, c, t, g, unknown or other
  modified_base (154)..(157): a, c, t, g, unknown or other
  modified_base (159)..(163): a, c, t, g, unknown or other
  modified_base (259)..(259): a, c, t, g, unknown or other
  modified_base (261)..(261): a, c, t, g, unknown or other
  modified_base (334)..(334): a, c, t, g, unknown or other
  modified_base (336)..(336): a, c, t, g, unknown or other
  modified_base (439)..(525): a, c, t, g, unknown or other
  modified_base (714)..(714): a, c, t, g, unknown or other
  modified_base (874)..(1215): a, c, t, g, unknown or other
  modified_base (1473)..(1473): a, c, t, g, unknown or other
  modified_base (2100)..(2100): a, c, t, g, unknown or other
  modified_base (2461)..(2463): a, c, t, g, unknown or other
  modified_base (2514)..(2514): a, c, t, g, unknown or other
  modified_base (2746)..(2748): a, c, t, g, unknown or other
  modified_base (3498)..(3498): a, c, t, g, unknown or other
  modified_base (3513)..(3513): a, c, t, g, unknown or other
  modified_base (3795)..(3795): a, c, t, g, unknown or other
  modified_base (3798)..(3798): a, c, t, g, unknown or other
  modified_base (3819)..(3819): a, c, t, g, unknown or other
  modified_base (4057)..(4548): a, c, t, g, unknown or other
  modified_base (4891)..(4896): a, c, t, g, unknown or other
  modified_base (4990)..(5400): a, c, t, g, unknown or other
  modified_base (5482)..(5490): a, c, t, g, unknown or other
  modified_base (5935)..(5940): a, c, t, g, unknown or other
  modified_base (6172)..(6177): a, c, t, g, unknown or other
  modified_base (6334)..(6334): a, c, t, g, unknown or other
  modified_base (6369)..(6369): a, c, t, g, unknown or other
  modified_base (6372)..(6372): a, c, t, g, unknown or other
  modified_base (6420)..(6420): a, c, t, g, unknown or other
  modified_base (6465)..(6465): a, c, t, g, unknown or other
  modified_base (6480)..(6480): a, c, t, g, unknown or other
  modified_base (6531)..(6531): a, c, t, g, unknown or other
  modified_base (6633)..(6633): a, c, t, g, unknown or other
  modified_base (6891)..(6891): a, c, t, g, unknown or other
  modified_base (6963)..(6963): a, c, t, g, unknown or other
  modified_base (6993)..(6993): a, c, t, g, unknown or other
  modified_base (7008)..(7008): a, c, t, g, unknown or other
  modified_base (7041)..(7041): a, c, t, g, unknown or other
  modified_base (7044)..(7044): a, c, t, g, unknown or other
  modified_base (7050)..(7050): a, c, t, g, unknown or other
  modified_base (7083)..(7083): a, c, t, g, unknown or other
  modified_base (7089)..(7089): a, c, t, g, unknown or other
  modified_base (7104)..(7104): a, c, t, g, unknown or other
  modified_base (7603)..(7917): a, c, t, g, unknown or other
  modified_base (8007)..(8007): a, c, t, g, unknown or other
  modified_base (8461)..(8463): a, c, t, g, unknown or other
  modified_base (8465)..(8466): a, c, t, g, unknown or other
  modified_base (8468)..(8475): a, c, t, g, unknown or other
  modified_base (8477)..(8477): a, c, t, g, unknown or other
  modified_base (8688)..(8688): a, c, t, g, unknown or other
  modified_base (8964)..(8964): a, c, t, g, unknown or other
  modified_base (8986)..(8988): a, c, t, g, unknown or other
  modified_base (9619)..(10275): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaagacgagcgggatgcaatccaaaagaagaccttcacaaaatggtttaatnaannnntnnnnnagaatgggaagaaagtcgaggatttgttcattgatctcagagatggcaataacctgattgacctgcttgaggcactcacttccgaacatttggtcntngagaacgggttcacgcgctttcaccggattcaaaatgtgcaatgctgtctggagttgctccgacgaaaaaatntnaaattagtcaacatacggcccgaggacattgtggagggcaatggcaaactcacacttgggctcatttggacaatcatcctgaacttccaagtgtccgccatannnnnnnnnnnnnnnnnnnnnnnnnnnnnnnnnnnnnnnnnnnnnnnnnnnnnnnnnnnnnnnnnnnnnnnnnnnnnnnnnnnnnnnacgcaagttttgtcggcacgtgatgctctgctggcatgggtgcgccgctgcacaagcagttatccagaagtgaatgtctccaacttctcaagcagttggaaagatggacttgcattttgcgcactgctccatcattaccgtccggagctggtcaattgggaaaaggtggaaaaagagctttttttgttncgtgaacgtcttcgtttcgcatttgatggtttcgagcgggaatttggcattgctaaactacttgatcccgaggatgttgatgtggacagtccggatgagcgttccctcatcacctacgtgtcccagctgcacaaccggctggtggatgaaccgaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggcaacctcgatgatcttgtgtcccgactcacacgtggaattggaatcaccaatgagaagcttgatcacatcctcacacgcatcgatgccgtcgacgcagcagcagagcgtggcgagcgtgtggaagtggagcgtcagattcgtgaaattgtcgacgacctttatgccctgaaaccgcccattgatgaattcttcgttgatgtggaaacattgcgccaacatcggcatccggaggcggcagatttccacaaacangtgcttggacttgaacagcgtcgcactgcctatttgggacgccttgaagacggcatcatggtccgtctcggcattcgctccaacaagatggaacgctacagctccacccatgtttcacaggcccacaagaatgccttccgtcgggtggaagatgccatccaatgggtccgagaccatacgtacaaactcaacacaatgcaattcagcgagacacttgaagtgttggagcagatgtttgagcagcacaagctggacaaccgtgacatccaagatttccgccaaaccgtggatgagtgcatcgccagacaggccgaagtgtcagcggaagactcctatgactactgtgaattgttgaagattctggagtctgaataccaacagttgcgtgaactctctgccggtcgaatggttgatttggactccctgattgcgttcatccgtgctgcccaactggaactggtttggattcacgaacgcgaagagttggaggtgacccgcaattggagcgatgtgcaacatttggacatcccaatgctgcaaaactatttcaaacagcttctgcatgaaattgagctgcacgagaagcaattcaacgatgttcacaaccaaggcgcagctctcatcaancagcgccatccagccggcgaggtcatcgaggtgtacctgcgcacaatgcaaaaccaatgggattggctcctgaacttgagcaaatgcttggaaggccatcttcgggatgcctacaatgccaaggcattcctggaggaagccgaccaagtggagcagcaaatgcaccaacaattgaatcatcttgaccaaggctataatcgcaccgaattctcgctggatgatggcgaacgcatgcttcgtgagcttgactccatccgtgagcacatccaacaactccatgcccggcttctgtcactcaccgaacgctgctcccaaatctccccattgtggcaacgcggcgaacgcattggacggccgattnnngtgacggcattgtgtgaataccgcagcaaggagattcacatcagacaagtngatgaatgcaccctgttggacaaccatgaccttcttcaatggcgtgtacgcggcatggacggcgttgaggcaaccgtgccatccgtcgtgttccgcatcccgccacctgatccacggcttgccaatctgctaagccgcttgcatggccaattcgaaaagttgcgcaaatcatgggaccgcaaacatcacttggtccgttacaacatggtgctgaacacaatgcgaacagtgnnnggatgggatttggacacgtttttgtcaattccgccggaccagcgagatgaaattataaaggcgttgaatgaggatgtgaacaagctgctggcagagttggatcccaatgatccattggcacgccggttgaaggaggagttgcgcctaacgaacgaacatttctacgatttgttggcccgtgcccagcgtggcccagagcccgactattccaatgaatttgatcatgccgcggcagagttaatccggaaattcgaagaagcttggaagcagctcagcgaacgagcacaagtgcgcattcccggcaacatggatgagctggaacatcagataaaggagcacaaagtttttgaagacaatcttcaggcgcttgacgtggatgtgtccaatgtgaaagagttgtaccgccaattgcccaacccaacacccaaccaacgtgccaaacatgacttgatgatttcgcgctgggaggaaatctgggaactttgccgaatgtatgtggagcggctgaaggcactggagaatgtgctgaagagtgtggatgaagtgacggacattgtgcgccgtcatgaagtcaccctttcctcgtttgatgacatgccctcagcacttgaacgccttcgtggcgtccatgcccaactagttgagctgaacatggtgcttcaacagcagcgaagcattgtggagaatctgaacaaagacacggcccaaattcggtcgcatgtggcacgcactcgactgggcgtgcaacancatcccgatgtggancagctggaggagatcgtgaccagcttgacagtgcgctgggacaatgtgaacagtcaagtgacggatcggctcaggattgccgaagaggcgcaacaaacgcagatggtttacagatcgcaatacgatgaagaactccaatggcttgaccgtgtcgaggcaaccatcaacagtctgcgcagacccgaagagttgcgtccggaagagcttcaaggccaattagaccaattgacggcggaatacgcccagctccaggagcacactgccaccattgaaaacatcaanaangaaggcggaaaattcattcgngatgcaaagggctatgacatcaaattggcccaataccatgacaacaccatcagcttccatggccaaagcatcaaggaggagttccgtcgccaagtgccgcagccaaagaatggagcgcaaattgtgacggaggagttggaggcgttaaaccgccgttttgcccaactctcctcagtgattctggagcgcaagaacatcgtgaatgtgctcattcagaattggcgcagaaaacagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagactgtcacgaaaactcagttctacgagatggaaggcattctgcacaaacagactggcgagattctcacctttgttgaggccattcgccagggtgacttgagcagaggaggcgaattctttgacattgttagcggttcacgtgtttcgcttgacaaagctgtggaaatgggccttatcagcgagaacatcaccgaaacactgaacagtcgacatggaatccgccatccggagaccggcgaagaggtgactttgatggaggccatccaaattggtctctacgatcctgactcacgtcaattgcgtgacatcaaaacgggcgatctgctttcattgtacgatnnnnnntcacgacacatttgcccaacggatgtgcagcatcggctcatcaaaatgggcgtgctgaagttgccacccatggagttggagcaagcattgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaatgcaataaaataatgtttttatcacaggttcttgaaaagggccaatacgattccagtggtcatttcctcgaccgtnnnnnnnnnggcaatcgcttcaccttactggaggccatcaacgccggccttctggatccagaagtgcgtcacattgtgtccgagcaagaccaagaagtgctttccattgctgatgccctggaacggggacttctctcaccggatggccgaattgtacttgaacaacaggaaaagcagatggatttgtacgatgctcaacgccaagggctgctgacacgccgtgtaagacacacaatctttgatgtaaagggcatccggaacacggagaacaacgcaaatttgagtttcaatgaggcagccgaagccggcatacttcaagtttctgctgaacgtgtgcttgaccaacaactgcagcaaaccttcatgctcagcgatgccgttcaaaaaggtctcatggattccgcactggcagacattctgtccacgccaagcggactttccgactctggtggcnnnnnngaagtctcattgatccgtgccgttgcaaaaggccttgtggatgccaccaagggcgttatcctcgaccgccgctcccaacgcgaattgaccgtgcgtgaagcttacgaccgtgggttcacttctctgcgtgccgcaatgcgcttggccgccctgtttgatgtgcacccactgttgatgacacccgtgaaaaagaagcacaaagctaggcgaatccaacgaccgggccaaccannnnnnttggccggcgatcaagtgaaagtgacattggccgaggcaatgcgccaaggcttgatcgatacccagcgcttccgacaaggaaaccaggaaatgtcgctagatgatgcacttcaccagggcctgattgatccacacagcgaatggattgtgccctcangggcatccggtgttgggccaaccattgaggagcgnacncaagaaacagtgacggaaactggccagcaattggcaccaaaagtttanccggacaaagagcttcaagagacagtgaacaccgtgaagcgcgtnaaacgcacggaaacnagtgcggtcggcggcccaggcggtgtcagcgtgtaccgcgcagtgacgggnggcaaaggctccattgaagtgccggccaatggctatcatgtgttggaagcggagaggaaaggcattcttgacttgggtcgtggcgttgtccatcctcccgcnaccgacaaatcattgagtctggaagaagcattcaatctgggcatcctcgatccacgctcagtcagcatcccgcaatcaagccgaaatctttccgtggatgaagcgctccaaaagaaggtgctcgacaggcacggcttcgtccatggacgcaatctgcaagaagccatcgatgagcgattggcgcacattgagccagagccaccggcaacgctgagtcaagcaaacaaaaaagtcattcaattttcgtcggctgccggnccggctgttgcattccgcccagttggaaagccggttgtggaagaacacgaacaagcctgggcttttgactcnaaccaaggcgtcttcattgatgcggccacnaatgagcacattccnctggattcggccatccgatcgggtcgtctctcngcngatgancttcgagcacgtgatgcactcacaggacgtgantattcnctgtcggaagccganaaatggggaattgtgaacatccgagagggctactatttggacaagactgacaacaaacgctactcatttgccgaggccgcacgtcagcatcggatttaccccacgggtggagtgcctgaaaatgcagccgatgcattgcacacgacagtgcgtgtccatacacgctcagaagtggcagtgcccagttccggccaaggcggtcatggcccagtggaatacaaccttcatcgttatgtgcagcatcaacaattcgacccatcaactggccttttctcgcatcccgacgtgcagaagcaaatgacactgaaggagttgatcatcaaaggcttgctgaacccatacagcacacgcattgtagacaaagcgaatggaacagagctacggctactcgatgccatccaagagcacattgttgatgatgtggccggaacggtgcgagacacgcaaaccggacgagtccatgactttgcgtcggctgttcggcaagggcttgtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggtggttcgccaagacttgtggagcgcaagcttcaattgaccccgtacgcgcaggaacccttccgagggtcctctccatcgggcgcngaacgaatggtggatttgggcggtggcaagacggtaaaagtgaatgtgatccgtggcgcggatggactagagaagggcgagtactttgatccggccagcaacatgaaattcaccatccaactccacggcgatccagtcacaacacagaccagcacgaaagtgcgatccacttcgcaagtccaatccgttgaattggagccgcacgcccaattcgttggcattgaccagatcaaggacatgcgcaacggccgagtgatgacattggccgacgcacaacgacttggccttgcccgtgtggaccgcaagggcaaacagagcaccaaggagtacagcgcattccgatcgaacattgagttggccgtcaacaagggcattctggatgcacgcggtgtcaagctgtccctggaggaagcaatccgacagcgacttttggacatacgcgaattgaagtacnnncnncnnnnnnnngnagcaattgatctgagcagtgcagcaaaccaaggcctggtggatgtcacactcgcggaaacgctgcccagtggagtgcacaacccagctactggcgagaagatcagcgttcaacgcgccgtcgacctgggaattgtgaatggacggactggggaagtgcggcacccgttgacgggcgaaaagctcagctgggtggatttgaccagaaaagtntacaatgcaatcacacaaaatggcgtctacgatccgcgcaaaggctacgccgttcccgtcgcctcggcacttgccgaaggcctcattgacacccgtgctgttgcctatctgaatccgattacccaagagcgcatttccttggaagaagccaaccaacgtggagtcatcgactcacaaacctaccatgcattgacaacgccatgtctcacggaccatcggtcaagaaggaaactaaatttggtgcaggccgttgatgcaaagttgattgatccacgngcaaaaaccgtccaaatttcgnnngacaaaattgtgcctctccaaaaggcagtcgaggaaggcgcccttccccgcgaagttggcgaacagcttcgccgcgtcgacaaaatgacatttgcggaagctgttggcaaaggcctgattgatgtggcccaagacaagttcacagacccggagagtggcaaacaaatcagtattgctgaggccgttcaacagggactcattgacacgggcgcagtgaagaatgatgagcccggggagaacaccaatttggcgaggctgattcaatccgagcattttgatgagaagtcgggacgagttcaagacccacgctctggattggcattgccgttcggcacggccgtcaaccaaagaatggtggacccagactctttgctgcacgatttggaatcctcaaaaacaatgaccattcgggaagccatcaacatgggcttggttgattcacacggccgctacgttccagccgcccaatcggtgccattgaaggaggccgtccagcgtggccttgtggccctcattggctcaccaatgcaagccgcacaggctgtcagcgaagcattgaaacgacgtgatgcggagggctacaaattccggctggaaccgctggatgatacgactgtgcaacggttgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 125 - DNA, 1413 bp, Artificial Sequence
  Description of Artificial Sequence: Synthetic polynucleotide
  modified_base (1)..(18): a, c, t, g, unknown or other
  modified_base (223)..(228): a, c, t, g, unknown or other
  modified_base (412)..(412): a, c, t, g, unknown or other
  modified_base (415)..(416): a, c, t, g, unknown or other
  modified_base (418)..(418): a, c, t, g, unknown or other
  modified_base (420)..(421): a, c, t, g, unknown or other
  modified_base (424)..(424): a, c, t, g, unknown or other
  modified_base (426)..(426): a, c, t, g, unknown or other
  modified_base (428)..(429): a, c, t, g, unknown or other
  modified_base (535)..(537): a, c, t, g, unknown or other
  modified_base (627)..(627): a, c, t, g, unknown or other
  modified_base (639)..(639): a, c, t, g, unknown or other
  modified_base (703)..(703): a, c, t, g, unknown or other
  modified_base (707)..(708): a, c, t, g, unknown or other
  modified_base (1137)..(1137): a, c, t, g, unknown or other
  modified_base (1239)..(1239): a, c, t, g, unknown or other
  modified_base (1326)..(1326): a, c, t, g, unknown or other
  modified_base (1378)..(1413): a, c, t, g, unknown or other
nnnnnnnnnnnnnnnnnncaccatctgactccggtcgacatgaccacggccacatccaaactccaattggaggcagcagaggttcggagcaataagccaaattggacatcctacttgcgttcccaattggtcccacaaaacgagtacaacttcattgtggcacttgaagcggccaaatcaaaagcggaacgcgatgaagtgctcaaccgggaccgggccaatnnnnnntccgccaaatgcataatcaatttggtcattgaagtggccaaggaccagttgattcgctacattctcactgtcttcgatgatttgcttcaggaggacaaatctcgtgttgaaattttccacgaattttcgcgtcgccagaagcgctccatttggtcatggttccagggaattttgacgcgtaatnatnnantnntantntnnaagatgtcgacgatttttgcaaaacttgcatgctatggatccacccacatggagggccaagaattgcaaacatatttcaactttctcaagagtgaactgcgaaatnnnccgaacaatgagtacatcaacacctccgtgcgctgtttgcaaatgatgctccgaagtgagccatatcgccgtgcttttgtggattgcganggagtgcccacnatcatttcggcgctggatggacgcgcaaatttccagctgcaataccaactcatcttctgccttnggtnnttgtcatttgacagcgcaatcgctcaatatctccaaagcatgggagtcatccaaacactcggtgatattctctctgagtgctcaaaggagaaagttgttcgcatcattttgcacactttccggaatttgcttgagaaaattgacaaccgtgatcttgtgcgtgaatccgcactccaaatggtccaatgcaagacgctgaaaacactggaattgatggatgcgaagaaattcgacgatgaagatttgttggaagacattgaatttctgtccgaacgtttacatgcatctgtgcaagatttaagctcctttgatgaatattgcaccgaaattcgctcaggccggcttcaatggagtccggtgcacaaatccgagaaattctggcgcgaaaatgcccagcgctttaatgagaagaatttcgaattgataganatgcttatcaaattgttggaatccagtggcgatcctttggtcctttgtgtggcagcacatgacattggcgagtatgtgcgccattatccacgcggcaaagcnattgttgaacaataccagggaaaacaagcggtgatgaaactgttgagtgccgaagatccaaacgtgcggtatcatgcgcttctaccnatccaaaagctgatggtgcataactgggaataccttggcaaacaattggatnnnnnnnnnnnnnnnnnnnnnnnnnnnnnnnnnnnn

SEQ ID NO: 126 - DNA, 3222 bp, Artificial Sequence
  Description of Artificial Sequence: Synthetic polynucleotide
  modified_base (1)..(297): a, c, t, g, unknown or other
  modified_base (319)..(319): a, c, t, g, unknown or other
  modified_base (384)..(384): a, c, t, g, unknown or other
  modified_base (387)..(387): a, c, t, g, unknown or other
  modified_base (418)..(418): a, c, t, g, unknown or other
  modified_base (420)..(420): a, c, t, g, unknown or other
  modified_base (435)..(435): a, c, t, g, unknown or other
  modified_base (477)..(477): a, c, t, g, unknown or other
  modified_base (501)..(501): a, c, t, g, unknown or other
  modified_base (516)..(516): a, c, t, g, unknown or other
  modified_base (531)..(531): a, c, t, g, unknown or other
  modified_base (577)..(894): a, c, t, g, unknown or other
  modified_base (1030)..(1030): a, c, t, g, unknown or other
  modified_base (1032)..(1032): a, c, t, g, unknown or other
  modified_base (1047)..(1047): a, c, t, g, unknown or other
  modified_base (1095)..(1095): a, c, t, g, unknown or other
  modified_base (1119)..(1119): a, c, t, g, unknown or other
  modified_base (1128)..(1128): a, c, t, g, unknown or other
  modified_base (1134)..(1134): a, c, t, g, unknown or other
  modified_base (1138)..(1138): a, c, t, g, unknown or other
  modified_base (1140)..(1140): a, c, t, g, unknown or other
  modified_base (1149)..(1149): a, c, t, g, unknown or other
  modified_base (1152)..(1152): a, c, t, g, unknown or other
  modified_base (1161)..(1161): a, c, t, g, unknown or other
  modified_base (1174)..(1174): a, c, t, g, unknown or other
  modified_base (1176)..(1176): a, c, t, g, unknown or other
  modified_base (1178)..(1178): a, c, t, g, unknown or other
  modified_base (1306)..(1308): a, c, t, g, unknown or other
  modified_base (1468)..(1992): a, c, t, g, unknown or other
  modified_base (2160)..(2160): a, c, t, g, unknown or other
  modified_base (2365)..(2541): a, c, t, g, unknown or other
  modified_base (2632)..(2667): a, c, t, g, unknown or other
  modified_base (2845)..(3222): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccctcgaacatgccgaaatntgccctcgttcacgcgtgtgccacaaatgttgctggttggattcgcctcatttgtgatggaagtnccntcagtcacaatgtgtcttgatcagtgtacanancctccaccagagacnggctttgtgtgcaaatccgtgatgtactactacaatgagcangagtgcattttgaacgcggaatcncgtcaatccaagccngatttgttcattccngaagaggatgactttgtggtaatttggacaacaacttgcgctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaattttttagcccctcgaacatgccgaaatgtgccctcgttcacgcgtgtgccacaaatgttgctggttggattcgcctcatttgtgatggaaaatgtcccatcagtcacaatgtgtcttgatcagtgtacanancctccaccagagacnggccagaattttgtgtgcaaatccgtgatgtactactacaatgagcangagtgcattttgaacgcggaatcncgtcaatcnaagccngatntnttcattccngangaggatgantttgtggtagaanantncgacattaactgccgcctggagcccgaacaatgcacgggcggccgccaagccaaattggtacgcaccctgaactcggcactgcccgaaggcgagggagccatccacgtgttggaaaccgtgcaggccnnnggagtgcaggaatgtgcccagaagtgtggggaacatgcgcccgacaagtgccgcgcattcaacttcgacaagtcctcgggcacgtgcaacctgctgtacttggacgggcgtggttcgttgaggcctgagaccaaggcacaagtgggattttttgaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagataaaacacagcgaacccttctcgggcgtcatctttgtcaagaacaaatacgacacctgtcgagcggagttcaactcggaacagagtgtcaccctggtgttaggactgcccgcaaactttggcatgaaacccatcagcttgcaccatccgggcccatcaaacacnacaaatcctgaccaatcctcatcggcagaagcggccgcggaattggcttcacaacagcaaagacgccgccatcgacgccaatcccaacgggactgcggtcttcaggacatggacaatggcacctacaaaaccgtggttgtcgttcagaccaacaatttgggcattcccggattggtcacttccatggatcagctttatgaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgacatcctggaactccgttgggaaatcatggccatggacgacgagctggacttcttcgtcaaggactgctacgccgagcccggcatcnnnnnnnnnnnnnnnnnnnnnnnnnnnnnnnnnnnnttaattttttccagttgcccaactccggcggttgcccagaagctgatcccgaacccgatcaaggtgctgagcagtgcggtcaaaattgcgcacctgcaagcgttccgctttgacagctcctccacggtacgcatcacctgccatttggagctgtgcaagggcgactgcaaatcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 127 - DNA, 2928 bp, Artificial Sequence
  Description of Artificial Sequence: Synthetic polynucleotide
  modified_base (1)..(117): a, c, t, g, unknown or other
  modified_base (328)..(329): a, c, t, g, unknown or other
  modified_base (580)..(580): a, c, t, g, unknown or other
  modified_base (582)..(582): a, c, t, g, unknown or other
  modified_base (606)..(606): a, c, t, g, unknown or other
  modified_base (612)..(612): a, c, t, g, unknown or other
  modified_base (615)..(615): a, c, t, g, unknown or other
  modified_base (657)..(657): a, c, t, g, unknown or other
  modified_base (660)..(660): a, c, t, g, unknown or other
  modified_base (687)..(688): a, c, t, g, unknown or other
  modified_base (693)..(693): a, c, t, g, unknown or other
  modified_base (709)..(709): a, c, t, g, unknown or other
  modified_base (718)..(718): a, c, t, g, unknown or other
  modified_base (726)..(726): a, c, t, g, unknown or other
  modified_base (844)..(846): a, c, t, g, unknown or other
  modified_base (1222)..(1602): a, c, t, g, unknown or other
  modified_base (1734)..(1736): a, c, t, g, unknown or other
  modified_base (1739)..(1739): a, c, t, g, unknown or other
  modified_base (1900)..(1902): a, c, t, g, unknown or other
  modified_base (2074)..(2928): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacccgcaaaatcaattcaggaatttgacaatctctatctggacatgaacggcattattcacccgtgcacgcatcctgaagatcggccagcgcccaaaaccgaagaggaaatgttcatcctcatcttcgagtacatcgatcgcctcttctccattgtgcggccccgcaaactgctctacatggccattgatggggtcgcgccacgggcanngatgaaccaacagcgcagtcggcgttttcgcgcagccaaggaggcggcagagaagcgtgaacagattgcacaaatccgaaaacggctccaagacgagggcgtcccgctgccaccgccgcgcaaagaggaggagcacttcgactcgaactgcatcaccccggggactccgtttatggcacggctgtcggatgcgttgcgctactacatccatcgacgggttaccgatgatccggcgtggaaaaacattcagntnatcctctcggacgccaacgtcccnggcganggngagcacaaaatcatggactacatccgccgccagcgcgcctcnccngcccacgacccgaacacggtgcactgnntgtgnggggcggacgccgacntgatcatgntggggctngccacccacgaggccaacttcaacatcatccgtgaggagtttgtgcccaaccagccgaagccatgcgagctgtgcggccagtacggccatgagttggaacattgcgaggggttggccnnncagggagagaagggcccggaccaggcggacccactgaagaaggagaagaatttcatcttcattcggctgccggtgttgagggagtatctggagcgggagttggccatgccgaatttgccgttcccgtatgacttggagagggccattgatgattgggtgatgatgtgcttcttcgtcggcaacgacttcctcccgcacctgccatcgctggaaattcgcgagaacgccattgaccggctggtgaagctgtacaagaacatggtctaccagactggcggttggctgacccacgatggggaggtgaacattgggcgcgtcaaaatgatcatggtcgagctgggcaaagcggaggatcagattttccgagagcgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccgcctgtgggaagctggctggaaggaccgctactaccaagcgaagttccaggtgcccgagagtgatggagcgtttcggaggaaggtggcttgtgcctatgtggagggactggcctgggtgttgcgctannnttntcagggttgtgccagctggacctggtactacccctaccactacgcaccgttcgcatccgactttgagctgatcgacgacttccagccaaacttcagcaaaacaactcgcccattcaaaccactcgaacaactcatgggcgtgtttccggcggctagcaggnnncacattcccgaagcctggcgttggctgatgactgacccaaactcacccatcattgacttctaccccgagaatttcgagattgacctgaacgggaagaagttcgcttggcaaggcgttgccctgttgccgtttgtggacgagaagcgactgctgagtgcgcttgagacggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 128 - DNA, 2730 bp, Artificial Sequence
  Description of Artificial Sequence: Synthetic polynucleotide
  modified_base (1)..(612): a, c, t, g, unknown or other
  modified_base (781)..(1122): a, c, t, g, unknown or other
  modified_base (1261)..(1263): a, c, t, g, unknown or other
  modified_base (1342)..(1344): a, c, t, g, unknown or other
  modified_base (1480)..(1482): a, c, t, g, unknown or other
  modified_base (1734)..(1734): a, c, t, g, unknown or other
  modified_base (1747)..(1747): a, c, t, g, unknown or other
  modified_base (1751)..(1751): a, c, t, g, unknown or other
  modified_base (1803)..(1803): a, c, t, g, unknown or other
  modified_base (1821)..(1821): a, c, t, g, unknown or other
  modified_base (1843)..(1843): a, c, t, g, unknown or other
  modified_base (1884)..(1884): a, c, t, g, unknown or other
  modified_base (1911)..(1911): a, c, t, g, unknown or other
  modified_base (1917)..(1920): a, c, t, g, unknown or other
  modified_base (1956)..(1956): a, c, t, g, unknown or other
  modified_base (2001)..(2001): a, c, t, g, unknown or other
  modified_base (2007)..(2007): a, c, t, g, unknown or other
  modified_base (2025)..(2025): a, c, t, g, unknown or other
  modified_base (2094)..(2094): a, c, t, g, unknown or other
  modified_base (2106)..(2107): a, c, t, g, unknown or other
  modified_base (2121)..(2121): a, c, t, g, unknown or other
  modified_base (2133)..(2133): a, c, t, g, unknown or other
  modified_base (2142)..(2142): a, c, t, g, unknown or other
  modified_base (2179)..(2340): a, c, t, g, unknown or other
  modified_base (2563)..(2730): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaaattttacatttgcggacctacagtttatgactcagcccacatgggccatgccagagcttacttatctttcgacattgtccgcagggtcctcactgactacttcaactatgacgtgctttatgtgatgaacataactgacattgatgacaaaataatcaaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgaaaatgaattcttgaaggacatgaacgcattgaatgtgatggagccggatgtgttgacccgagtcagtgaatacattcccgatatcatcgaatatgtgcaaaagattattagaaatggctacgcctatgttttgnnngatggctctgtttattttgacactgcggcttttgataccaagactggccatttctatgcaaaacttttacccgaagcannnaagaaggataaggaaaatgaagagaaacatatgcgtgagggcgagggtgaactgagcaattgcgcaattaatctttcaggaaaacgctcttcatctgattttgctctttggaaagcatcaaaaaatggcgaacctnnntgggacagtccttggggaaaaggtcgcccaggttggcacattgagtgctcggcaatgagtacagccatttgcggggacaaactcgacatacatgccggtggatttgacctcaagtttccgcatcatgacaatgaaattgcgcagtgcgaagcgcacagtgactgtgaccattgggtgaactattttcttcattgcggcacgctaagaattgagggcttgaagatgtcaaaaagtctgaagaatttcattacnatcaaagaggcantganaaaatacacggcacgtcagttgcgaattcttttcctgatgcatatttggtcngataatttggattactgngattctaccatggaacacgccntgcattttgagaaattttgcaacgaattcttcctcaatctnaaggacattgtgcgcaaacaacagaangaaatnnnnatttagtgcttcaaaaagtttgacagaaatgaagtngatttgatgcataaactgagccaaatccgcgctgaaatccacaangccctntgtgattcaatcgacacncggaccgttttagagaaaattcgaacaatgcttggcttaatgaacacttacatcatggagaggaaacangaagaagcccanntcaactgcaatttnctaagcaacacngcaaactangtgttgaaattgttgcgaatttttggcgcagatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaaaggaatgcgatcggttacgcgacgacattttgcctgaattgggtgttcgtcttgaagatcacaccaaggatacttgtgtgaaactggtggacagagaagtgctgatgaaagagaaggctcagaaggaagcaatgctgaaggaaaaggctgaacggaaattgcaggaggaagaaaagcggctgaaaaaagcagcaaaggaggaagccaagcggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 129 - DNA, 1476 bp, Artificial Sequence
  Description of Artificial Sequence: Synthetic polynucleotide
  modified_base (1)..(78): a, c, t, g, unknown or other
  modified_base (163)..(165): a, c, t, g, unknown or other
  modified_base (199)..(201): a, c, t, g, unknown or other
  modified_base (744)..(744): a, c, t, g, unknown or other
  modified_base (1020)..(1020): a, c, t, g, unknown or other
  modified_base (1167)..(1167): a, c, t, g, unknown or other
  modified_base (1240)..(1242): a, c, t, g, unknown or other
  modified_base (1338)..(1338): a, c, t, g, unknown or other
  modified_base (1468)..(1476): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnttagtttatcgcacagtgacaggtgtcaatggtcctttggtcattcttggtgatgtcaaattcccgcaatatgctgagattgtcnnncttaccttacccgatggaaacacacgaactggcnnngtgttggaagttaccaaggataaagcagttgtacaggttttcgagggcacctccggaattgatgctaaaaatacgatttgtgaattcactggcaccattctacgaacacccgtctcggaaagcatgcttggccgaattttcaacggttcgggaaaacccattgacaaaggcccaaaagtgttggcagaagattcttggacatcaacggacaggccaataaatccggagtcgcgtatttatcccgaagaaatgatccaaactggtatttcggcaattgatgtgatgaatagcattgctcggggccagaaaatcccaattttctccgctgctggtcttccgcataatgaaattgctgcgcaaattgtgcgccaaggaggccttgtgaagctgcccaatcgcaagcatggtgaaaccgattttgcaattgtgtttgcggccatgggtgtcaacatggaaacagcacgtttcttcaaacaggatttcgaggagaatggctccatggagaatgtctgccttttcttgaacttggccaatgacccaacnattgaacgcattattacgcctcgattggctctgacatgtgctgaattcctcgcttaccaatgcaacaaacacgtgcttgttgtgctcaccgacatgtcctcctatgctgaagcactccgtgaagtttcggctgcacgtgaagaagtgcccggtcgccgtggattccctggatacatgtataccgatttggccaccatctacgaaagggcaggccgtgtggagggcagaaagggttcaattacacaaattcctattctcaccatgccgaatgatatnataacccatcccattcccgacttgactggctacattacggagggacaaatttatgttgaccgtcaattgcataatcgtcaggtttatcccccaatcaatgtgctgccttctttgtctcgtctgatgaaatcggccattggcgaaggnatgactcgagaggaccattctgatgtttccaaccaactctacatgtgctatgctattggcaaggatgtgcagnnnatgaaagctgtcgttggtgaggaagctctctcgtcagacgacttactctaccttgaattcctgactaaattcgagaagaatttcatctcccaagtnaattatgagaatcggactgttttcgactcattggacattggctggcagctattgcggatattccctcgcgagatgctaaaacggatccccgcaaagatcctcgacaaatactacccgagaggaggtgctnnnnnnnnn

SEQ ID NO: 130 - DNA, 939 bp, Artificial Sequence
  Description of Artificial Sequence: Synthetic polynucleotide
  modified_base (1)..(42): a, c, t, g, unknown or other
  modified_base (370)..(370): a, c, t, g, unknown or other
  modified_base (373)..(375): a, c, t, g, unknown or other
  modified_base (377)..(377): a, c, t, g, unknown or other
  modified_base (411)..(411): a, c, t, g, unknown or other
  modified_base (540)..(540): a, c, t, g, unknown or other
  modified_base (546)..(546): a, c, t, g, unknown or other
  modified_base (591)..(591): a, c, t, g, unknown or other
  modified_base (594)..(594): a, c, t, g, unknown or other
  modified_base (598)..(598): a, c, t, g, unknown or other
  modified_base (652)..(652): a, c, t, g, unknown or other
  modified_base (654)..(654): a, c, t, g, unknown or other
  modified_base (657)..(659): a, c, t, g, unknown or other
  modified_base (661)..(661): a, c, t, g, unknown or other
  modified_base (664)..(664): a, c, t, g, unknown or other
  modified_base (919)..(939): a, c, t, g, unknown or other
nnnnnnnnnnnnnnnnnnnnnnnnnnnnnnnnnnnnnnnnnnggagctcttaatgctgcgccacaggactcgaatcaagtggatacggctgagacggtctacattagctcattggcattgctgaaaatgttgaaacatggacgtgctggtgtgccaatggaggttatgggcctaatgttgggagaatttgtcgatgactatacggtgaatgtaattgatgtgtttgcaatgccgcagtctggaacgggagtttctgtggaagcagtggatccggtattccaagccaagatgattgacatgctcaaacaaactggtcgcccagaaatggttgttggttggtatcactcgcatcctggctttggctgctggnttnnngncgttgacgtgaacacacagcaaagttttgaagcnctctcggatcgcgccgtggctgttgtggtagatccgattcaatccgtcaagggaaaggtcgtgatcgatgccttccgtacgatcagtcagcaaacaattgcattgaatcaggaaccacgccagacaacnagcaanattggccatctgcagaaaccttcaatccaggcgctaattcatggnctnaacngacactattattcaattcccattgcctatcgcatcagcgaaaacgaacaacagntnttnnngnatntgaacaagcaaagctggatggatgcaatgagcttggaaaaatacagtgtccactgtggttctaccgagaagcaggcggctgagatattgaaacaagccaaactgtacaagaagtcattggaagaagaggagaagatgaccgacgaacaactggccatcaagaatgtgggcaagcaagaccctaagcgccatttaggtgacaccgtcaacgcaatgctcgccgataatctggtgcagagtctggctgcgcagttgnnnnnnnnnnnnnnnnnnnnn

SEQ ID NO: 131 - DNA, 2559 bp, Artificial Sequence
  Description of Artificial Sequence: Synthetic polynucleotide
  modified_base (31)..(33): a, c, t, g, unknown or other
  modified_base (219)..(219): a, c, t, g, unknown or other
  modified_base (438)..(438): a, c, t, g, unknown or other
  modified_base (547)..(549): a, c, t, g, unknown or other
  modified_base (1224)..(1224): a, c, t, g, unknown or other
  modified_base (1329)..(1329): a, c, t, g, unknown or other
  modified_base (1882)..(1884): a, c, t, g, unknown or other
  modified_base (2155)..(2157): a, c, t, g, unknown or other
  modified_base (2191)..(2191): a, c, t, g, unknown or other
  modified_base (2367)..(2367): a, c, t, g, unknown or other
  modified_base (2557)..(2559): a, c, t, g, unknown or other
atggtgaacttcacggttgacgaaattcgcnnncttatggacaagaagaagaacatccggaacatgtccgtcattgcccacgtcgaccatggcaaatcaacgctgaccgactcgttggtgtccaaggctgggatcattgctggcgcaaaggctggcgagacgcgtttcaccgacacccgaaaggatgaacaggagcgttgcatcaccatcaaatcaacngccatttcgatgttctttgagctcgacccaaaagacttggacttcatcaagggcgacaaccaatgcgagctgcagcaagtggacggccagaacaagaagtacaacggcttcctgatcaacttgatcgactcgcccggacacgtcgacttctccagcgaggtcaccgctgctcttcgtgtcacggacggagccctggtggttgtggattgtgtttctgtngtttgtgtccaaacggagactgtgttgcgtcaggcgattgcggaacgcatcaagcccgtgctgttcatgaacaagatggaccgtgccctgctcgaactccaactcggcnnngaggaactcttccaaacgttccagcgcattgttgagaacatcaacgtgatcattgccacctacggggacgacgatggcccgatgggacccatccaagtggacccttcgattgggaatgtcggctttgggtcgggtctgcacggctgggccttcacgctcaagcaatttgccgagatgtatgccgacaagtttggtgtgcaggttgacaagttgatgaagaacctctggggcgaccgcttcttcaacctgaagacaaagaagtggacaaacacccaagagccggacaccaagcgcggattctcccaatttgtgctggatccaatctacaaagtgttcgactgcgtcatgaacatcaagaaggacgagaccagcaagcttgtggacaaactgggcgtcaaactgaccaatgaggagaaggaacaagagggcaaaccgctgctgaagacaatcatgcgcaagtggcttccggctggtgaaaccatgcttcagatgatttgcatacacttgccttcgccggtgactgcccaaaagtaccgaacggaaatgctttatgaaggcccgcacgatgatgaagcggctgtcgccatgaagacttgtgatccgaacgggccattgatgatgtacatctccaagatggtgccaacatcggacaagggccgcttctatgcatttgancgcgttttctcgggcaaagtcgcaactggaatgaaggcccgcatccaaggccccaactatcaagtcggcaagaaggaggacctttatgagaagacaatccaacgnaccatcctgatgatgggccgctacattgagcccattgaggacatcccagcggggaacattgccggattggttggcgtggaccagtacctggtgaagggcggcacaatcaccacctacaaggacgcccacaacatgcgtgtcatgaagttctccgtctcgcccgttgtgcgtgttgcggttgagccgaagaatgccggcgatttgccaaaattggtggaaggcctgaagcgtctggccaagtccgatcccatggtccaatgcatcttcgaggagtcgggcgagcacatcattgccggcgccggtgaactccacttggaaatctgcttgaaggacttggaggaggaccatgcctgcattcccatcaagaagtccgacccggtggtgtcctatcgcgaaacggtgacggaagagtccgagatcatgtgcctttccaagtcgcccaacaagcacaaccgtctcttctgcaaagcgcgtccattgcccgatggtctggccgaagcgatcgagaagggcgaagtcgacccgcaggatgagccgaagaaccgcgccaagnnnctggccgagaagtacgaattcgacgcaactgacgcccgaaagatctggtgctttggaccagagggcaccggctcgaacttgttggttgacgtgaccaagggagttcaatacttgaatgaaatcaaggattcggttgttgctggcttccaatgggccaccaaggagggcgtcctctgtgacgagaacatgcgcggcattcgcttcgacatccacgatgtgacactccacgccgacgcaatccatcgtggcggtggccaaatcatcccgactnnncgccgtgtcttctatgcttccgtgctgactgctnagccacgcatacaagagcccgtctatctggtcgaaatccagtgcccggaagcggccgttggtggcatctacggagtgctgaaccgtcgccgtggtgttgtgttcgaagagagccaaattgccggcacaccgatgttcatcgtcaaggcacatttgcccgtcaacgagtcgtttgcnttcaccgccgatctgcgctccaacaccggtggacaagcgttcccacaatgtgtgttcgatcactggcaggttcttcccggcgatccgctggaggccaactctcgcccggcccaagtggttgcggacacgcggaaacgcaagggactgaaggagggcgtgcccggactggacaacttcttcgacaagctcnnn

SEQ ID NO: 132 - DNA, 762 bp, Artificial Sequence
  Description of Artificial Sequence: Synthetic polynucleotide
  modified_base (354)..(354): a, c, t, g, unknown or other
  modified_base (634)..(762): a, c, t, g, unknown or other
atggataaatacgatcgggccatcaccatcttttcgccagacggtcgcttatttcaagttgattacgcgcaggaagccgtcaagaagggttccactgctgttgcaatcaagggaaaggactgtgtcatcattggagttgaaaagaaatcggttcccattctccaggacgatcgcaccatccgtaagattcacgagctggacaatcacgtcatggccgctttctctgggcttagcgctgacgcacgagttctcatcgactctgcgcgacgggagtgcgaatcatacaaattgacattggaggacccggtcacattggcgcacatttctcgtctgattgccgacatcaagcaggangtttaccaaacaactggccgccgtccattcgggatttccatgctggtggctggcattgatcccgacggaacgccgcgcctcttcaccacggaaccatcgggcgtctattacgaactgttggccggctcaattggacgcaacgagaaggtggtgaaggaatatttggagaagcactacagcgacgccaccaccgcggacgaagtcagcactctgcaattgactgtcaaggcactctcgcctgtggtccaatcgggtgcgcaaaatatggaaattgcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 133 - DNA, 747 bp, Artificial Sequence
  Description of Artificial Sequence: Synthetic polynucleotide
  modified_base (225)..(225): a, c, t, g, unknown or other
  modified_base (351)..(351): a, c, t, g, unknown or other
  modified_base (561)..(561): a, c, t, g, unknown or other
  modified_base (661)..(747): a, c, t, g, unknown or other
atgtttctgacaagaagcgagtatgatcgaggtgtgaacacattctcgccagaaggacgacttttccaagtggaatatgcgatggaggctgtcaaacttggcaccaccaccatcggaatacacaccaaggagggcattgtgctggcagctgagcgtcgaactgtttctcgtctggtcgtggaggattccatccgcaaagtgtcaaaaattgacggtcacattttngccgcttctgccggattaattgctgacgcacgaacatgggttgagcgtgcacgcaatgaggcacagcaatacacattcgtttatggacagaagatgcgcgttcaggacgtcactatgcgggttaancattttacacttttgttttatcttcaatttttaaagattcgtctgggccgtccattcggcgttgccatgcttttcgcgggcattgacagcgatggcgcccacctcttccacctggacccatctgggacttacatcaagtgccttgcaaaagcaatcggtgccggcggtgatggcgcagagcaaatactccgtgaacagtgcttgaaccgnatgaccatggcagaggcgcgcaccattgcattgacaacgcttaagcagttgatggaggagaaaatcaacgcaaagaatgtggaagttgttctaatcaagnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 134 - DNA, 4494 bp, Artificial Sequence
  Description of Artificial Sequence: Synthetic polynucleotide
  modified_base (1)..(60): a, c, t, g, unknown or other
  modified_base (231)..(231): a, c, t, g, unknown or other
  modified_base (781)..(783): a, c, t, g, unknown or other
  modified_base (1140)..(1140): a, c, t, g, unknown or other
  modified_base (1203)..(1203): a, c, t, g, unknown or other
  modified_base (1228)..(1230): a, c, t, g, unknown or other
  modified_base (1354)..(1355): a, c, t, g, unknown or other
  modified_base (1357)..(1363): a, c, t, g, unknown or other
  modified_base (1366)..(1367): a, c, t, g, unknown or other
  modified_base (1369)..(1369): a, c, t, g, unknown or other
  modified_base (1371)..(1371): a, c, t, g, unknown or other
  modified_base (1486)..(1486): a, c, t, g, unknown or other
  modified_base (1807)..(1932): a, c, t, g, unknown or other
  modified_base (2692)..(2850): a, c, t, g, unknown or other
  modified_base (2893)..(2895): a, c, t, g, unknown or other
  modified_base (3024)..(3024): a, c, t, g, unknown or other
  modified_base (3168)..(3168): a, c, t, g, unknown or other
  modified_base (3451)..(3453): a, c, t, g, unknown or other
  modified_base (3681)..(3681): a, c, t, g, unknown or other
  modified_base (4492)..(4494): a, c, t, g, unknown or other
nnnnnnnnnnnnnnnnnnnnnnnnnnnnnnnnnnnnnnnnnnnnnnnnnnnnnnnnnnnnggacttgaacgcgtttcggaataccagcgttttgatggctggttcaacaatcttgcaaatcctcaatggggttcggtgggaagtcgactccatcgggatgcgcccagcaaataccaggacggcgtctaccgactggactcttccttgccttcggcacgcatcatttcgggnttgatgttcaaaggggaatccggaaggcccagtcagaggaatttgacgacaatgttggcattttcaggccaagtagttgcctacgaaatcatgcaatccacgcagaacagttgcccgctggaaatgcacaaaattacagttgccaaatgcgatccagtgtttgacaaaaagtgcgaaggtcgaacggaaattcctttcacccgtgccaaatacgacaaagaaacgggacatggtctgaattcgcctcgggagcaaatcaacgagcggaccagttggattgatgcctctttcctctactccacacaagaaccctgggtggctgcgttgcgttccttcgagaatggcactttgttggaagggatggccggctatccgcccttcaacaatccccacatcccgctgatcaacccgccacccccgcaaatccatcggctgatgaatccggaaaggcttttcattttgggcgacccgcgcataaacgagaacccgggattgctcagcttcgggctcatcctcttccgttggcacaacattcaggccaggcggttgnnnagagaattcccggaatggacggacgaggaattgtttcagggcgcacggcggttggtcattgccacgcttcagagcataattctttatgaattcctgcctgccctgcttggcccaaatgtgacaattttggaatacaaaggctacaacccgcatgttcctccgggaatttcccattccttcgccaccaccgcattccgtttcccgcatacgctggtgccgcccgcacttctgttgaggaagaggaccagcaagtgcgaatttcggaaggaggtgggcggcttccctgcattacggctttgccaaaattggtggaatgcgcaagacattgtgatcgaatattcagttgatgagattggnctgggtatggcttcacaaattgccgaagaagaagatcacattgttgttgaagaccttcgagtntacatctttggaccaatgcatttcnnnagacttgatgtcgtctccacttccatcatgcgtggccgagacaatggattgccaagttacaatgaattacggcaagcgtatggattgaagcgaagggaatggcatcagataaacacacggctgnncnnnnnnnatnnananaaagtggaaacacttatgaagctttacaactccagcattgacaggcttgattcctacgtgggcggcatgctggaagcggacggaaatgggccgggcgaactttttaccgcaatcntcaaggatcaatttgaacggcttcgagattctgaccgtttttggtttgaaaacaaacaaaatgggttgttcacagaacgtgagattggattcatacgtaaaatcacgcttcgtgacattattcgccaaacgacatccattgaaaaggaggacattcaagacaatgttttcttttggcgtgccggtgacccttgtccgcagcctttccaagtgaatgtaaccggtcttgaggaatgcgtgccattcatgcgcttcgaccatttcacgggcaatgaagtcacctacatcttcacttgcttggcactgttcacaattcctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcagcaattgaatggctcaatgaggcgttctgccgctccatcacagtggagttggactcagcacaactgcggattctgaagcgccgcggaggcattctcaggaagctggatttctccgaagtgcacgcgattcgattggtgacgaagaaaagcggacgaaaggctggacatggcccatttgtttgcatcagtgcacccaaaaattatgacgtggtgctgcgtctttcctcagaacatcattgggccaaattccgatgtgccttgggcaattgcctgttaaggcacagaaaactgttgaaggaggtggaagccgagaatgacgtgctcctggaggcagccgagaccaaagacaaacggcaagccaaactggaccatttcttccgagaggcttactcacgggcattcaatgtgccccagttgagtgaccattcctcacagtacaacacagcttccgaacaaatcatgaacatgacactgacaaaggcggaatttgctgaagcattggggatgcgtgcaggcgatttgttcgtgcagcgcatgtttgcgtgcatggcacggcagaacgacacggtggtcacattccaagagtttttggacgtgttgcgcaaattcacgcaaggatcgttgaaggagaaactgcaattggtttttgacatgtgtgacttgaacaaggaaggatgcgtgcaacggcaccaattctgtgaatttgtaaaatcgttgaacatggccgccggagtgcgaattgaccaagatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacacaaagcttgaacagctttgcagtgacagccgaagctnnngaagaagccttccacaaaaactccatctcattgttgctcagctacctggaaagttaccggcagcacattgttgtgctcttcctcttctttgccgccaatgccatcgttttcctggaacgtttttggtcntatcgatacgaaaacgagcatcgtgacttgcgacgtgtcatgggcgtgggaattgccatcacgcgcggtgccgcagccgctttatcctttgacatggcactcatcctgttgactgtgtgtcggaatgtgctgaccttgttaganaatataatccagcaacagtatttgcctttggattctgccatcactttccacaaaatagtggccatcacggctggcgtttttgccgcaattcacaccattggccattgtgtcaacttttaccatgtagccacgcagagccaggaaggattggcctgtcttttccaagaggccgtcttcggctccaattttctgccttccatttcctattggttcttccaaacattgacaggaatcacgggcattctcctggtagccacaatgtccatcatttacgtcttcgcgnnnccggctgtcatgaaacgcgcttaccatgcgttccgaatcacgcatctgctgaatgtgctcctctatgcactgaccattctccatgggctgccaaaattgcttgattcacccaaattctggtacattgtgctgggcccgaccgtcattttcatcatggaccgcatcattggcatgcgcaaacactacaagcaattgcgcattgtggatgccgccatccttccatcggcnataatctacatccaattcaaacggcctcactccttcaagtttcgcagtggccaatgggtgcgtatctcttgtccggcattgtcttgtgccttcaatgaacatcatgcattttcactggcttcagcaccacaagcacccacactggagttattcatcaaggcagtcggaccatggacttggagtttgcgcaatgaaatcaatgaagcacaggccaacggactttcatacccagttgtgaacttgaatggaccttacggggatgggaatcaggaatggcacaaccatgaggtggttgtcatgatcggaggtggcatcggtgtaaccccgtacgcatccactctcatggatttggtgctggaacgcgcttctggcaatcacagtggcatcaaatgccgtaaagtttacttcctctggatttgcccaacccataaaaacttcgaatggtttgtggatgtgctgaaagaggtggaaactttcgaccaggagaatgccctcgagatccacatctttgtcacccaattcttccataaattcgatcttcgcactaccgtgctgtacatttgcgagaagcacttccggggtgacaattcgggcctgagcatgttcacaggtcttcgggccacaaaccattttggccgacccaattttgatcttttcttcaaattccttcagagtcggcatcaggatgtgcccgaaatcggcgtgttcagttgcgggcctgcccaagtgaacaagcaaatccggagagcgtgcaccgaagcaaaccgcatccggaacgcaccttcttttgtgcacagattcgaaacattcnnn

SEQ ID NO: 135 - DNA, 1293 bp, Artificial Sequence
  Description of Artificial Sequence: Synthetic polynucleotide
  modified_base (1)..(48): a, c, t, g, unknown or other
  modified_base (66)..(66): a, c, t, g, unknown or other
  modified_base (78)..(78): a, c, t, g, unknown or other
  modified_base (81)..(81): a, c, t, g, unknown or other
  modified_base (195)..(195): a, c, t, g, unknown or other
  modified_base (421)..(421): a, c, t, g, unknown or other
  modified_base (625)..(625): a, c, t, g, unknown or other
  modified_base (657)..(657): a, c, t, g, unknown or other
  modified_base (672)..(672): a, c, t, g, unknown or other
  modified_base (675)..(675): a, c, t, g, unknown or other
  modified_base (711)..(711): a, c, t, g, unknown or other
  modified_base (829)..(829): a, c, t, g, unknown or other
  modified_base (873)..(873): a, c, t, g, unknown or other
  modified_base (1264)..(1293): a, c, t, g, unknown or other
nnnnnnnnnnnnnnnnnnnnnnnnnnnnnnnnnnnnnnnnnnnnnnnngagaattggaaggcgganctgaatcttccnacnaaagaccttcgctacaaaacagccgatgtgactgcaaccaagggaatcgaattcgaagagtttggcctttcgcgcgatcttctgaagggaattttcgagaagggatgggaacgncccagtcccatacaggaagcgtcgattggcattgcgctatcagaacaagacattttggcgcgagcaaagaacgggaccggcaaaacgggtgcctactgcattccttgcatagaaaagattgatacatccaaggagaacatccaagcaatgatcattgtgccaacccgtgagcttgcgctccaaacttcgcaaatttgtgtggaactcagcaaacacctcaacatanaggtcatggtcactacgggtggtacggatttgcgcgacgacattctgcgtctcaatggcgttgtccacttggtggtggccactccgggccgaattctggatttgatggagaagggagtggccaacgtgtcccaatgcaaaaccgtcgtactcgacgaggcggacaaactgctctcacaagacttccaaggtgttctggaccgtntggtgcattttctgccgcacgaccgccaaatnatgctctactcggcnacnttcccgcgcacagtggccacattcatgaacaagcanatgcagcgaccctacgagataaacctgatggaggagctcactctgctgggcatcacccagttctacgcgtacgtgcaggagaagcagaaagtgcattgcttgaacacactcttccgcnagctgcaaatcaaccagtccatcatcttctgcaattccacccancgtgttgagctgcttgcgaagaaaatcaccgaactcggctactcttgctactacatccactccaagatggcccagcaccatcggaaccgggtgttccacgaatttcgccaaggccattgccgcaacctggtgtgctctgatctgctcacgcgcggcatcgacatccaggccgtcaacgtggtcatcaacttcgactttccgcgcaactccgagacgtacttgcacagaattggacggtctggacgttttggccacctcggcattgccatcaacctcatcacctacgacgaccgctacaacttgcgacgcatcgagaaggagctgaaaacgcacattgagcccatcccgaaggaggtcgatcccaagctgtatgtggccgaacatcaactgnnnnnnnnnnnnnnnnnnnnnnnnnnnnnn

SEQ ID NO: 136 - DNA, 1704 bp, Artificial Sequence
  Description of Artificial Sequence: Synthetic polynucleotide
  modified_base (1)..(21): a, c, t, g, unknown or other
  modified_base (394)..(396): a, c, t, g, unknown or other
  modified_base (717)..(717): a, c, t, g, unknown or other
  modified_base (727)..(727): a, c, t, g, unknown or other
  modified_base (918)..(918): a, c, t, g, unknown or other
  modified_base (983)..(984): a, c, t, g, unknown or other
  modified_base (986)..(987): a, c, t, g, unknown or other
  modified_base (1194)..(1194): a, c, t, g, unknown or other
  modified_base (1209)..(1209): a, c, t, g, unknown or other
  modified_base (1215)..(1215): a, c, t, g, unknown or other
  modified_base (1221)..(1221): a, c, t, g, unknown or other
  modified_base (1230)..(1230): a, c, t, g, unknown or other
  modified_base (1254)..(1254): a, c, t, g, unknown or other
  modified_base (1266)..(1266): a, c, t, g, unknown or other
  modified_base (1290)..(1290): a, c, t, g, unknown or other
  modified_base (1302)..(1302): a, c, t, g, unknown or other
  modified_base (1308)..(1308): a, c, t, g, unknown or other
  modified_base (1314)..(1314): a, c, t, g, unknown or other
  modified_base (1344)..(1344): a, c, t, g, unknown or other
  modified_base (1379)..(1379): a, c, t, g, unknown or other
  modified_base (1527)..(1527): a, c, t, g, unknown or other
  modified_base (1699)..(1704): a, c, t, g, unknown or other
nnnnnnnnnnnnnnnnnnnnntcatccgatgaaggcgatgagatggaagagggcaccagcagcagttttgttggcaaacattcgcagctggcagtcgccctgccttctgttaatttggctccgcaagtgattgctcaacgagatgtccaaactgttgctgtggttgacccaaagacaaaggaactttattacaaccccaaatacgaagagcttttccagccagagtctggtccaagcaatccattcaaaagcgaacatcaacgtgcccaaaagaacatgctaacgggctttgtcgaacccgcccatgtcaatcaattccattttgaacgcgccattcgctcgtatgacaccctgggctatgcagaaaatccatcggctgatgcgggcaataccnnntttattggcaacgtggcaaaagccgaagagacaggcggcaaatcgctttttgaatcgacaaaaactggcggacaaaagcggaagcgggttgtcaactacgatgcctccgatgtggatggctacaccgggccctgggctcgttatgaaaatgaacaaactgtggccaagccagatccagaattgcaaaaggaaatggacgaaataatccgaaagaagaaagcgaagagccgcattggacggaagctggccgtcgaggagttgcatttggccgaagagagcacaaagctgcacatcaaagacgataaagactatttgggacgntcattcatgnaagctccaaagagtgttggcgtgaatctaaggcccgatcatgtgcccgagcgttgctatcctccaacaaaacaagcccacacttacaacagccacaccaagccagtcacggccattcgttggttcccccgcagtgcgcatatgttcctgtcttgttcaatggatgggaaggtgaaactttgggaagtctangggaatcgcaaactgatacgcacctacactgggcataaagttcctgtcaaagacatttacttcannanngatggcacagagttcttgagtgccgcttatgacaattacatcaaattatgggataccgaaacaggacaagttaaatcacgctttacaattggacacagagcttatgtggtcaagttcaatcctgatgaggacaaacaaaatctattccttgctggaatgtcaaacaagaaaatcattcaatgggacacaagaagtggcgaaattgancaggaatatgaccgncacctnggtccngtcaattcnataacatttttcgacaaaaatcgnagatttgtttcnacttctgacgataaatcacttcgnatatgggaattnggaatncccgtngacacaaaaatcatccaacacgctggactncattcaataccttccatgacaaaagcaccgaatgntaaatggatagttggacagtccatggataatcggattgtgcttttccaaattgtcgatgacaaacttcgttttgcacgcaaaaaggcctttcgtgggcataacactgccggatatgcatgctatgcggatttctcgcctgatatgagnttcattgcatccggagacgctgacgggaaaataaccatgtgggattggcgaacacacaaaatcgtttccacttggaaggcgcatgacaatgtgtgcatctctgtcctatggcatcctcacgagaagagcagaatgatcagctgtggatgggacaattccatcaagatgtggnnnnnn

SEQ ID NO: 137 - DNA, 951 bp, Artificial Sequence
  Description of Artificial Sequence: Synthetic polynucleotide
  modified_base (1)..(30): a, c, t, g, unknown or other
  modified_base (400)..(474): a, c, t, g, unknown or other
  modified_base (691)..(951): a, c, t, g, unknown or other
nnnnnnnnnnnnnnnnnnnnnnnnnnnnnnggcatcttggctttgttgctggtccttttcaaagtgctcgccgcactctggcgcatcctctggccctatgtgcttggacggccaaaatcgttggaagcgctggctggtggcaattgggcactggtgacgggctgcactgatggcattgggcgtgcttatgctgccgagcttgcttcccgtggcatcagccttgtgcttgtttcgcgttcggcacaaaaactggccgaaatggaggccgaattccgtcggcgttttgccaagcccgacttcctgaccgtagcctttgacttctccgaaccttcagttgccgtttacaagcagttacttgccaagattcagcacttgccaattggcattcttggtaagaatnnnnnnnnnnnnnnnnnnnnnnnnnnnnnnnnnnnnnnnnnnnnnnnnnnnnnnnnnnnnnnnnnnnnnnnnnnnacgattaacatgcatccagtcacgcttctctccgcctttgtgcttgaccaaatgacaaaaaggggacaaggcgttatcgtgaacatctccagcatgattggctatcgaccatgcttctaccagaccatctacgctgcaacaaaggcttatgtgaattgcctatctcaatcacttcgcctggaatatgccaaccagggcattcacattcagacggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 138 - DNA, 783 bp, Artificial Sequence
  Description of Artificial Sequence: Synthetic polynucleotide
  modified_base (256)..(345): a, c, t, g, unknown or other
  modified_base (634)..(783): a, c, t, g, unknown or other
atgttccgcaaccagtacgactcggacgttacggtcttcagtccacaaggacgcttgcatcaggttgactacgctgtggaggcaatgcgacagggcagcgcaaccgtggccatccagggcaaggatcatgccgttgtggtcgcactcatgcgggcacagaatgagctttcggcattccaagagaagatcttcagcgtggatgagcacttgggcctctccatgtccggactgctggcggatggccgcatcttggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaaaagaacacgcaatactacggctcgcgtccattcggcgttggattgctgctcattggctacgacgatctcggaccacacgttctcaaggccgaaccgtcgggcatggtcaccgccgagtacgcggccgcaattggcgcacgttcgcagagtgcacgaacctacctggagaagcacatggacgcttggaaagacggagacctcgacacgattgtcaagcacgcgctgttggcattgaaggagacgctgcaagccgacagcaacaaactggaccagaacgtaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 139 - DNA, 648 bp, Artificial Sequence
  Description of Artificial Sequence: Synthetic polynucleotide
  modified_base (1)..(9): a, c, t, g, unknown or other
  modified_base (120)..(120): a, c, t, g, unknown or other
  modified_base (246)..(246): a, c, t, g, unknown or other
  modified_base (646)..(648): a, c, t, g, unknown or other
nnnnnnnnnggagacaacatcccaaccttcaagcttgtactggtcggtgatggcggcacgggaaagaccacatttgtgaagcgacacttgactggcgaattcgagaagaaatacatccanacgcttggcgtggaagtgcatccgctgactttccacacaactcgcggccaaatccgcttcaatgtctgggacacagccggtcaagagaagttcggtggactccgtgatggctactacattcaagancaatgtgccatcgtcatgtttgacgtaactgcccgggtcacctacaagaatgtgccgaactggcaccgcgatttggtgcgcgtttgcgagaacattccaattgtgctcgtcggcaacaaggtggacgtgaaagacagaaaagtgaaggccaagagcatcaccttccaccgcaagaagaatctccagtactacgacatctcggccaagagcaactacaacttcgagaagccgttcctctacctggccaggaagttggtgggagacccgaatctcgagttcgtcgccatgccagcattggccccaccggaggtgcacatggaccctgctctggcggcccaatacgaacaggaagtgaaggaggctgccaacgccgaactgccggatgacgatgaggacatcnnn

SEQ ID NO: 140 - DNA, 1128 bp, Artificial Sequence
  Description of Artificial Sequence: Synthetic polynucleotide
  modified_base (1)..(945): a, c, t, g, unknown or other
  modified_base (1126)..(1128): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatgaagcggattgccccaaaagacctgaaagtgcgcattctggcaccccaggagcggatgtactccacctggattggcggctccatcctcgcctcgctggacactttccgcaaaatttgggtgaccaagcagcagtacgactccattggcaagggcatcattgccaggaagacatttnnn

SEQ ID NO: 141 - DNA, 858 bp, Artificial Sequence
  Description of Artificial Sequence: Synthetic polynucleotide
  modified_base (1)..(183): a, c, t, g, unknown or other
  modified_base (207)..(207): a, c, t, g, unknown or other
  modified_base (225)..(225): a, c, t, g, unknown or other
  modified_base (234)..(234): a, c, t, g, unknown or other
  modified_base (288)..(288): a, c, t, g, unknown or other
  modified_base (300)..(300): a, c, t, g, unknown or other
  modified_base (507)..(507): a, c, t, g, unknown or other
  modified_base (841)..(858): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgttcgtcgtggctatgaagtntacaagcaagtgtgtgcngcatgccantccatgaagttcatccgttaccgacactttatcaacaacttcatgacggaagangaagccaaagcngaggctgccgaagcgctcattgatgacattgacgacaatggccaaccaatgaagcgtcccggcatacccaatgactttttgccatcaccttatccaaacatgagagccgcggctgccgccaacaacggagcagcgccgcccgatctttcgctgatggcctgggcacgtgaaggcggagacgactacattttccatttgctcactcgntacttcgacactcccgaaggcattcaagtggacgaaggcaaagcctacaatccgtacttcccgggtggcgttttggccatgcctcagcaattgttcgacgaaggcattgagtaccaggacgggacaccagccacaatgagtcagcaggcaaaggatgtgacaacgtttttgcgctggtccgctgaacaatggcatgatacaaggaaaaaatatgcgcttgtgctggtcatgctgacaccaatcgtgatcttcactctgcttgctgcaaagaagcatgtgttcgccccgatcaagaccgagaaattcttccatcgcacggtgaagggacgagaannnnnnnnnnnnnnnnnn

SEQ ID NO: 142 - DNA, 1308 bp, Artificial Sequence
  Description of Artificial Sequence: Synthetic polynucleotide
  modified_base (36)..(36): a, c, t, g, unknown or other
  modified_base (58)..(58): a, c, t, g, unknown or other
  modified_base (78)..(78): a, c, t, g, unknown or other
  modified_base (150)..(150): a, c, t, g, unknown or other
  modified_base (171)..(171): a, c, t, g, unknown or other
  modified_base (185)..(188): a, c, t, g, unknown or other
  modified_base (190)..(190): a, c, t, g, unknown or other
  modified_base (192)..(192): a, c, t, g, unknown or other
  modified_base (220)..(220): a, c, t, g, unknown or other
  modified_base (237)..(237): a, c, t, g, unknown or other
  modified_base (338)..(338): a, c, t, g, unknown or other
  modified_base (340)..(341): a, c, t, g, unknown or other
  modified_base (343)..(343): a, c, t, g, unknown or other
  modified_base (345)..(346): a, c, t, g, unknown or other
  modified_base (348)..(349): a, c, t, g, unknown or other
  modified_base (351)..(351): a, c, t, g, unknown or other
  modified_base (353)..(353): a, c, t, g, unknown or other
  modified_base (355)..(356): a, c, t, g, unknown or other
  modified_base (358)..(359): a, c, t, g, unknown or other
  modified_base (362)..(363): a, c, t, g, unknown or other
  modified_base (375)..(375): a, c, t, g, unknown or other
  modified_base (377)..(378): a, c, t, g, unknown or other
  modified_base (383)..(388): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (401)..(402): a, c, t, g, unknown or other
  modified_base (408)..(408): a, c, t, g, unknown or other
  modified_base (411)..(411): a, c, t, g, unknown or other
  modified_base (426)..(426): a, c, t, g, unknown or other
  modified_base (429)..(440): a, c, t, g, unknown or other
  modified_base (442)..(442): a, c, t, g, unknown or other
  modified_base (444)..(445): a, c, t, g, unknown or other
  modified_base (447)..(448): a, c, t, g, unknown or other
  modified_base (454)..(456): a, c, t, g, unknown or other
  modified_base (459)..(459): a, c, t, g, unknown or other
  modified_base (463)..(463): a, c, t, g, unknown or other
  modified_base (654)..(654): a, c, t, g, unknown or other
  modified_base (657)..(657): a, c, t, g, unknown or other
  modified_base (660)..(660): a, c, t, g, unknown or other
  modified_base (663)..(663): a, c, t, g, unknown or other
  modified_base (669)..(669): a, c, t, g, unknown or other
  modified_base (675)..(675): a, c, t, g, unknown or other
  modified_base (684)..(684): a, c, t, g, unknown or other
  modified_base (687)..(687): a, c, t, g, unknown or other
  modified_base (693)..(693): a, c, t, g, unknown or other
  modified_base (696)..(696): a, c, t, g, unknown or other
  modified_base (702)..(702): a, c, t, g, unknown or other
  modified_base (705)..(705): a, c, t, g, unknown or other
  modified_base (708)..(708): a, c, t, g, unknown or other
  modified_base (717)..(718): a, c, t, g, unknown or other
  modified_base (720)..(721): a, c, t, g, unknown or other
  modified_base (723)..(724): a, c, t, g, unknown or other
  modified_base (726)..(726): a, c, t, g, unknown or other
  modified_base (831)..(831): a, c, t, g, unknown or other
  modified_base (862)..(866): a, c, t, g, unknown or other
  modified_base (868)..(873): a, c, t, g, unknown or other
  modified_base (876)..(879): a, c, t, g, unknown or other
  modified_base (892)..(892): a, c, t, g, unknown or other
  modified_base (894)..(895): a, c, t, g, unknown or other
  modified_base (897)..(897): a, c, t, g, unknown or other
  modified_base (900)..(900): a, c, t, g, unknown or other
  modified_base (909)..(909): a, c, t, g, unknown or other
  modified_base (913)..(913): a, c, t, g, unknown or other
  modified_base (918)..(918): a, c, t, g, unknown or other
  modified_base (921)..(921): a, c, t, g, unknown or other
  modified_base (927)..(927): a, c, t, g, unknown or other
  modified_base (930)..(930): a, c, t, g, unknown or other
  modified_base (936)..(936): a, c, t, g, unknown or other
  modified_base (939)..(939): a, c, t, g, unknown or other
  modified_base (948)..(948): a, c, t, g, unknown or other
  modified_base (951)..(951): a, c, t, g, unknown or other
  modified_base (954)..(954): a, c, t, g, unknown or other
  modified_base (957)..(958): a, c, t, g, unknown or other
  modified_base (960)..(960): a, c, t, g, unknown or other
  modified_base (969)..(969): a, c, t, g, unknown or other
  modified_base (975)..(975): a, c, t, g, unknown or other
  modified_base (1152)..(1152): a, c, t, g, unknown or other
  modified_base (1203)..(1203): a, c, t, g, unknown or other
  modified_base (1276)..(1276): a, c, t, g, unknown or other
  modified_base (1280)..(1280): a, c, t, g, unknown or other
  modified_base (1284)..(1284): a, c, t, g, unknown or other
  modified_base (1306)..(1308): a, c, t, g, unknown or other
atgcctgatcacttgggagatgatatgcgcaaagtnaaggacggatcggatgagaccnctaaagaagaagttaaagtnttgggcgaagaggaaatcgctgccctgaaaagctacaacatggggccttattcggagaaattgcgtcaagtngagaaggacattgaggaggcnatgaagggcataannnncntntgcggtgtcaaggagagtgacactgggntggcgcctcccgcgctntgggaccttgctgcggacaaaatggccatggctcaggaacaaccacttcaggttgcaagatgcacaaaaatcataaaggccgaaggacaagagcctcgctncnngntnnanntnangnnanncgnnaaattcgttgtngnnctggnnnnnncngtngcnccaanngacatngangaggggatgcgggtnggnnnnnnnnnnnnanannannagatcnnnctnccgntgcctgccaaaatcgacccaaccgtgaccatgatgcaagtggaggaaaagccggatatcacttatgcggatgtgggtggctgcaaagaacagattgaaaagctccgcgaagtcgttgaaatgccacttctccaccccgaacgctttgtcgacattgggattgaaccgcccaaaggagtgttgttctacggnccnccnggnactggnaaaacnctttgcgcncgngcggtngcnaatcgnacngangcttgcttnntnngnntnatcgggtcggaattggtgcaaaagtacgtgggtgaaggcgcccgcatggttcgtgaacttttcgaaatggcaaagagcaagaaagcttgcatcattttcttcgcngaagtcgatgccattggaggcgctcgtttcnnnnntnnnnnnggnnnngacaacgaagtgnanngnacnatgctgganttgntcaancanttgganggntttgantcncgcggagcnatnaangtnntnatggccacnaatcgnccagacactttggacccggcactcgttcgtcccggccgcatcgacagaaaagtggaatttggattacccgatctcgaggcacggacaaacatcctgaaaattcacacgaaaaggatgagtgttgacaggaacattcgctatgaactcatttctcgtctttgcccgaacacgacagcngccgatatccgttcagtttgcaccgaggcaggcatgtttgcgttgcgagcncgtcgcaaggtgatcaccgagaaggacttcttggatgctgttcagaaagtggtaagttccgctgaattatttngttncacncccagctacatgacgcacaacnnn

SEQ ID NO: 143 - DNA, 492 bp, Artificial Sequence
  Description of Artificial Sequence: Synthetic polynucleotide
  modified_base (1)..(297): a, c, t, g, unknown or other
  modified_base (393)..(393): a, c, t, g, unknown or other
  modified_base (396)..(396): a, c, t, g, unknown or other
  modified_base (430)..(492): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagatcgacgacaacggcaaaatcagccgccaacgcattgagtgcaactcggccacctgcggtgccggcattttcatggcaaagcacaaggancgncactactgcgggaaatgccaccaaaccgtggttnnnnnnnnnnnnnnnnnnnnnnnnnnnnnnnnnnnnnnnnnnnnnnnnnnnnnnnnnnnnnnn

SEQ ID NO: 144 - DNA, 1821 bp, Artificial Sequence
  Description of Artificial Sequence: Synthetic polynucleotide
  modified_base (1)..(48): a, c, t, g, unknown or other
  modified_base (180)..(180): a, c, t, g, unknown or other
  modified_base (330)..(330): a, c, t, g, unknown or other
  modified_base (337)..(343): a, c, t, g, unknown or other
  modified_base (347)..(348): a, c, t, g, unknown or other
  modified_base (610)..(610): a, c, t, g, unknown or other
  modified_base (624)..(624): a, c, t, g, unknown or other
  modified_base (648)..(648): a, c, t, g, unknown or other
  modified_base (663)..(663): a, c, t, g, unknown or other
  modified_base (732)..(732): a, c, t, g, unknown or other
  modified_base (984)..(984): a, c, t, g, unknown or other
  modified_base (1135)..(1135): a, c, t, g, unknown or other
  modified_base (1137)..(1137): a, c, t, g, unknown or other
  modified_base (1143)..(1146): a, c, t, g, unknown or other
  modified_base (1151)..(1151): a, c, t, g, unknown or other
  modified_base (1155)..(1155): a, c, t, g, unknown or other
  modified_base (1158)..(1158): a, c, t, g, unknown or other
  modified_base (1161)..(1161): a, c, t, g, unknown or other
  modified_base (1163)..(1163): a, c, t, g, unknown or other
  modified_base (1170)..(1170): a, c, t, g, unknown or other
  modified_base (1173)..(1173): a, c, t, g, unknown or other
  modified_base (1192)..(1192): a, c, t, g, unknown or other
  modified_base (1227)..(1227): a, c, t, g, unknown or other
  modified_base (1254)..(1254): a, c, t, g, unknown or other
  modified_base (1281)..(1281): a, c, t, g, unknown or other
  modified_base (1290)..(1290): a, c, t, g, unknown or other
  modified_base (1302)..(1302): a, c, t, g, unknown or other
  modified_base (1305)..(1305): a, c, t, g, unknown or other
  modified_base (1308)..(1308): a, c, t, g, unknown or other
  modified_base (1318)..(1320): a, c, t, g, unknown or other
  modified_base (1324)..(1325): a, c, t, g, unknown or other
  modified_base (1743)..(1743): a, c, t, g, unknown or other
  modified_base (1810)..(1810): a, c, t, g, unknown or other
  modified_base (1819)..(1821): a, c, t, g, unknown or other
nnnnnnnnnnnnnnnnnnnnnnnnnnnnnnnnnnnnnnnnnnnnnnnngttgtcaaggctgaaaacatgttgggcgcagcaatgtatgaactagtccgggttgggcattacgagttgattggcgaaatcatccgaatcgaacgcgacaccgccacaattcaggtctatgaggaaacggcngggctggcaattggcgaccctgtattgcgaaccggaaagccactctcagttgaacttggtcctggaatcattgggaacatcttcgatggaattcaacgacctctgcacgatattgcacaaataacaaagtcaatctacatcccacgagcnataaacnnnnnnncccnnaatcggaccaaaaagtgggatttcgagccgaatcaacgactaaagaagggcgaccatgttgctggcggtgatgtggtcggcattgtgcacgagtcgatgctggtcaagcacaagataatggtgccgccaactgaacaaggaacagtcaaatatgttgcgcccaaaggccgatacacagtcaaggacacaatcatggaattggagtattcgggccaaacccacaagtatccaatgtaccacgtctggccagtgcgcacacccngaccggtgcaaganaaactggcagccgaccatcctctnctttgcggtcaacgngttctggacgccctcttcccctgtgtgcagggagggacaacagcaattccagatgcctttggctgtggnaaaaccgtcatttcccaatcgctctccaaattttccaactccgatgtgatcatctacgtgggctgcggcgagcgtggaaatgagatggccgaagtgttgcgcgatttcccccaactcaccatggaagtgggcagcaaaacaacgtccatcatggaacgcactgtgctggtcgcgaacacctcaaacatgcccgttgctgctcgcgaggcttccatctataccgctatcacaatggccgaatatttccgcganatgggcctgaacgtggccatgatggcggactccacctctcgttgggctgaggcattgcgtgaaatctccggacgtcttggtgaaatgcccgcagacaatggctatccggcctatctatcgtctcgtcttgccgacttctacgaacgtgccngnaaagtnnnntgccntggnacnccncnacgcganggntctgtcacaattgttggcnccgtttcaccgcctggcggcgacttcgccgatccngtcacttgcgccactctgggcattgtncaagtcttctggggtttggacaagaanctggcacancgcaaacacttnccntcngtcaattggnnnatcnntttcagcaagtacatgcgcgcactggacgactactatgagaagaactttgccgaattcgtgccactccgtaccaaatgcaaggagattctgcaggaagaggaggacttgtccgaaatcgtgcaattggtcggcaaagcatcgctggccgaatcggacaaaatcacgctggaagtggccaagctgatcaaggacgacttcctccaacagaatggctacactccctacgaccgcttctgcccattctacaaaaccgtgggaatgctcaagaatatgattgcattctacgatttcgcacggcactcggtcgagtcgacggcacagtcggacaacaaaatcacgtggggaatcatccgagaccacatgggcgacctcctctacgagctttcctccatgaaattcaaggaccccgtgaaaganggtgaagagaaaatcaagaaggactatgaggacttgcacgaacggctacagacggcattccgcaacntggaagacnnn

SEQ ID NO: 145 - DNA, 2421 bp, Artificial Sequence
  Description of Artificial Sequence: Synthetic polynucleotide
  modified_base (1)..(750): a, c, t, g, unknown or other
  modified_base (1035)..(1035): a, c, t, g, unknown or other
  modified_base (1221)..(1221): a, c, t, g, unknown or other
  modified_base (1306)..(1308): a, c, t, g, unknown or other
  modified_base (1626)..(1626): a, c, t, g, unknown or other
  modified_base (1675)..(1689): a, c, t, g, unknown or other
  modified_base (1971)..(1971): a, c, t, g, unknown or other
  modified_base (2010)..(2010): a, c, t, g, unknown or other
  modified_base (2097)..(2097): a, c, t, g, unknown or other
  modified_base (2146)..(2151): a, c, t, g, unknown or other
  modified_base (2295)..(2295): a, c, t, g, unknown or other
  modified_base (2389)..(2421): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaagtcggatggcactgttaagtggagcactctagagcataaagggccaatgtttgcccccgaatatgttccaatcccaaagactgtcaagttcaaatacgatgggaagcccatggagctttcaactgctgccgaagaagttgcatcattttatgcaaagatgcttgaacatgactacacttcaaagccgatcttcaacaagaactttttcaaggattggcggaaagttatgacccattcagaaaaggagaagatcacagacttgaagaagtgtgattttacngaattacatgcccattttgtggcggaaagtgaaaaaaggaaggcaagaagcaaagaagagaagaaagaggaaaaggaagcaaaagacaaggaggcaaaggagtatggatttgcaactttggatgggtacaaacagaaaataggcaattttcgaattgaaccacctggtcttttccgtggtcgagcngaacatccaaaaatgggatgtttgaaaaagagaatccagccggaggacgtggtcattaattgttcaaagggagttcatataccannnccgccaaaaggtcacaaatggaaagaaatccgtcatgacaataccgtcacatggctttgttcttggactgaaaatgttttgggcagcaacaaatacatcatgttgaatccatcttcaaagcttaaaggacaaaaagattgggaaaaatttgagaaagcgcgcaagttaaaaggtttcgttggtcccattcgtgaccaataccttacggacttcaagagcaaggagatgcgaatccgccaacgagccgtagcactttatttcatcgacaaacttgccctcagagctggcaatgagaaggatactgaagaagctgctgtnacggttggttgttgttctcttcgctgcgaacatatcaaactgcatgatnnnnnnnnnnnnnnncatgatgagatggatgaccagaaatatgtggttgaattcgatttccttggaaaggattccattcgttactacaatcgtgtgcccgttgaaaaggctgtgtacaaaaatttgaagatctttatggaaggcaaggaacccagcgatgacctttttgatcgacttgatacaagctcattgaatgcttatctgaaggaattgatggaaggattgacagcaaaagtgttccgcacatacaacgcatcaatcacattgcaggaacaactggataaactaaccaatctngatgacccaattcacgaaaaattgctctcctacaatccngcaaatcgacaagttgccattctctgtaaccatcaacgtgcgtgccaaaaagtcatgacaaagccatggagaatttggagaacaaanatcaaggacaagaaagctgaatacaaaaagacaaaggcagaactgaagnnnnnnaagaataaaagcgacgagaagttgcagaaaaaatatctgcgtgtgaaagagcaacttgacaaattgaagacacagcgcactgacaaggatgagaacaaacaaattgctctgggcacttcaaaattgaattatttggatccgagnatttccgttgcttggtgcaagaaatatgaagtgcccgtggagaagattttttcaaagacgcaacgtgacaaattccgctgggcgatagacatgnnnnnnnnnnnnnnnnnnnnnnnnnnnnnnnnn

SEQ ID NO: 146 - DNA, 1140 bp, Artificial Sequence
  Description of Artificial Sequence: Synthetic polynucleotide
  modified_base (1)..(6): a, c, t, g, unknown or other
  modified_base (148)..(189): a, c, t, g, unknown or other
  modified_base (403)..(403): a, c, t, g, unknown or other
  modified_base (405)..(407): a, c, t, g, unknown or other
  modified_base (409)..(409): a, c, t, g, unknown or other
  modified_base (411)..(412): a, c, t, g, unknown or other
  modified_base (414)..(414): a, c, t, g, unknown or other
  modified_base (416)..(419): a, c, t, g, unknown or other
  modified_base (424)..(424): a, c, t, g, unknown or other
  modified_base (426)..(426): a, c, t, g, unknown or other
  modified_base (430)..(431): a, c, t, g, unknown or other
  modified_base (433)..(433): a, c, t, g, unknown or other
  modified_base (435)..(436): a, c, t, g, unknown or other
  modified_base (438)..(438): a, c, t, g, unknown or other
  modified_base (441)..(444): a, c, t, g, unknown or other
  modified_base (446)..(447): a, c, t, g, unknown or other
  modified_base (450)..(451): a, c, t, g, unknown or other
  modified_base (456)..(456): a, c, t, g, unknown or other
  modified_base (527)..(527): a, c, t, g, unknown or other
  modified_base (556)..(556): a, c, t, g, unknown or other
  modified_base (564)..(565): a, c, t, g, unknown or other
  modified_base (612)..(612): a, c, t, g, unknown or other
  modified_base (642)..(642): a, c, t, g, unknown or other
  modified_base (937)..(939): a, c, t, g, unknown or other
  modified_base (969)..(969): a, c, t, g, unknown or other
  modified_base (1006)..(1140): a, c, t, g, unknown or other
nnnnnncaagaagaaatccatttggagggttgtaatttttttcgtcagcatataatcttctcgctattgactggtagacctgtgaagatcactcaaattcgttcatatgatgactcgccaggaattcgaggttccgatttacgcttannnnnnnnnnnnnnnnnnnnnnnnnnnnnnnnnnnnnnnnnnatcacttcatcaggaacacaagtggaattccgtcccggtattattcatggcggtgaactggaaatggattgtgggatggaacgttgcatcagctattttcttgaaccacttgtcgtgttggcgccattttgcaaacatccaatcagcgcaaatttaaaaggagtgacaaacaaatcagatgagattagtgtggatgcaattcgtaccacttggntnnncntnntntnnnnttttntnttanntnannangannnntnnatnnaggtnaatgcgcgaggattgctcccagatggcggcggctcgattacatttacaagcccaataaaacgcaatctgcnacccgtacaattggttaaacagggaaaantttgcaanntccgtggattggcttggatttgtaagatttcaccttcaattgcttcnagaatgattgaaggtgctaagaaaatgctncatggatatatagctgatgtctacattacaattgatcagcgaaaaggccctcaaggcggattatcaccgggattcggaatattcatcagcgctgaaactactgaaggcgttttctatcatggcgaagcaatgtcaaatccgaaggattctgagaaaagccaagcagtgcctgaagaagttggagaggaggcagcaaaacgacttttaaacgagatatataagggcggatgcactgattcttctgcccaatcattggctgcaacttttatgaccttatgcgacaaggatgtatcannntttctgtttggtccgatgagcatttattgngttcacactttgcgcaatttgaggctattttttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 147 - DNA, 3582 bp, Artificial Sequence
  Description of Artificial Sequence: Synthetic polynucleotide
  modified_base (1)..(45): a, c, t, g, unknown or other
  modified_base (139)..(139): a, c, t, g, unknown or other
  modified_base (141)..(144): a, c, t, g, unknown or other
  modified_base (147)..(148): a, c, t, g, unknown or other
  modified_base (150)..(150): a, c, t, g, unknown or other
  modified_base (159)..(159): a, c, t, g, unknown or other
  modified_base (189)..(189): a, c, t, g, unknown or other
  modified_base (204)..(204): a, c, t, g, unknown or other
  modified_base (241)..(241): a, c, t, g, unknown or other
  modified_base (246)..(246): a, c, t, g, unknown or other
  modified_base (288)..(288): a, c, t, g, unknown or other
  modified_base (291)..(291): a, c, t, g, unknown or other
  modified_base (312)..(312): a, c, t, g, unknown or other
  modified_base (351)..(351): a, c, t, g, unknown or other
  modified_base (354)..(354): a, c, t, g, unknown or other
  modified_base (359)..(364): a, c, t, g, unknown or other
  modified_base (366)..(369): a, c, t, g, unknown or other
  modified_base (375)..(375): a, c, t, g, unknown or other
  modified_base (377)..(377): a, c, t, g, unknown or other
  modified_base (380)..(381): a, c, t, g, unknown or other
  modified_base (489)..(489): a, c, t, g, unknown or other
  modified_base (552)..(552): a, c, t, g, unknown or other
  modified_base (603)..(603): a, c, t, g, unknown or other
  modified_base (645)..(645): a, c, t, g, unknown or other
  modified_base (696)..(696): a, c, t, g, unknown or other
  modified_base (705)..(705): a, c, t, g, unknown or other
  modified_base (928)..(930): a, c, t, g, unknown or other
  modified_base (1125)..(1125): a, c, t, g, unknown or other
  modified_base (1128)..(1128): a, c, t, g, unknown or other
  modified_base (1131)..(1131): a, c, t, g, unknown or other
  modified_base (1147)..(1147): a, c, t, g, unknown or other
  modified_base (1152)..(1152): a, c, t, g, unknown or other
  modified_base (1195)..(1195): a, c, t, g, unknown or other
  modified_base (1212)..(1212): a, c, t, g, unknown or other
  modified_base (1224)..(1225): a, c, t, g, unknown or other
  modified_base (1230)..(1230): a, c, t, g, unknown or other
  modified_base (1242)..(1242): a, c, t, g, unknown or other
  modified_base (1263)..(1263): a, c, t, g, unknown or other
  modified_base (1266)..(1266): a, c, t, g, unknown or other
  modified_base (1311)..(1311): a, c, t, g, unknown or other
  modified_base (1329)..(1329): a, c, t, g, unknown or other
  modified_base (1341)..(1341): a, c, t, g, unknown or other
  modified_base (1347)..(1347): a, c, t, g, unknown or other
  modified_base (1350)..(1350): a, c, t, g, unknown or other
  modified_base (1381)..(1383): a, c, t, g, unknown or other
  modified_base (1489)..(1491): a, c, t, g, unknown or other
  modified_base (1683)..(1683): a, c, t, g, unknown or other
  modified_base (1822)..(1968): a, c, t, g, unknown or other
  modified_base (2212)..(2313): a, c, t, g, unknown or other
  modified_base (2531)..(2531): a, c, t, g, unknown or other
  modified_base (2535)..(2535): a, c, t, g, unknown or other
  modified_base (2727)..(2729): a, c, t, g, unknown or other
  modified_base (2731)..(2732): a, c, t, g, unknown or other
  modified_base (2739)..(2739): a, c, t, g, unknown or other
  modified_base (2890)..(2892): a, c, t, g, unknown or other
  modified_base (2980)..(2980): a, c, t, g, unknown or other
  modified_base (2983)..(2983): a, c, t, g, unknown or other
  modified_base (3169)..(3171): a, c, t, g, unknown or other
  modified_base (3258)..(3258): a, c, t, g, unknown or other
  modified_base (3433)..(3441): a, c, t, g, unknown or other
  modified_base (3541)..(3582): a, c, t, g, unknown or other
nnnnnnnnnnnnnnnnnnnnnnnnnnnnnnnnnnnnnnnnnnnnngaatatgaagacgaagatgacgagatctcgactgaactctggcaagaagcctgctgggtggtcatctctgcgtatttcgacgagaagggcttgntnnnncannanttttccagnttcgacgagttcattcaaatgatcgtgcancgcattgtggaggantctccggcggtggaactccagaccgagctgcaacacnccacnggtgaaatcgagtcgcccaccaagttctcgctcaagttcggncanatctacttgtccaagccaacncactgggagaaggacggcgccccaactccgctgatgccnaangaggnnnnnntnnnnaacctnanctnntcatcgcctctgtacgttgacatcaccaagaccatctcgaaggagggagaggaggatcaagtggcctaccagaaggtgttcatcgggaagattccaatcatgcttcgntcgagctactgtgtcctttccaatctgactgaccgcgacttgaccgagctgaacgaatgcccnctggacccgggcggctacttcatcatcaacggcagtgagaaagtgctcatngcgcaggagaaaatggccaccaacacagtctacgtgttctcnatgaaggacggcaagtacatgtacaagacggagtgccgttcctgcttggancagtcctgncgtccatcttctactctttgggtgaacatgaccaaccgcggcggcggaaaggctgggaaaaatgctatgggccagaagatcatcgcaatcattccgtacatcaagcaggaaatcaacataatcatcgtgttccgcgccctcggcttcgtctccgaccgcgacattctcgagcacatcatctacgactttgacgaccaggaaatgatggagttggtgaagccannnctggacgaagcattcgtggtccaagagcagcaggtggcactgaacatgattggaactcgcggggcaaagccgggcgtgacgaaggaggcacgaatccgctatgcgcgcgaaattctgcagaaggagatgctgccccatgtgagcattgcggaacattgcgagacgaagaaggcgtatttcctcggctacatggtncancgnctgctgctggccgctntgggncgtcgtgagctggatgaccgcgatcacatgggaaacaagcgtntggatttggccggcccnctgttggcttcnntgttncgtgcactcttncggaatttgctcaaagaggtncgnctgactgcccaaaagtacatcaacaagaacggcgatttcaacctngacgtgtgtgttcgcccnacaatcatcacncgcggnctncagtactcgttggccactggcaattgggggnnncagaagaaggcgcatcaaacgcgggccggcgttagtcaggttctcaaccgtctcacctacacagccaccctctcccacttgcgccgttgcaattcgcccattggannngaggggaagctggcaaagccgcgtcaactgcacaacacccaatggggaatggtttgccccgcggaaacgcccgaaggccaggccgttgggctggtgaagaatttggcactgatggcgtacatttccgttgggtcgcagcccgagccaatcctggagttcttggaggaatggagcatggaaaatttggaagangtttccctcgctggccattgcaaacaacacgaaatctttgtgaacggctcctgggtgggcatccatcgtgatccggaccagttgatgaccacactgctcaagctgcgtcgccaaatggacatcattgttagcgaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaataccaatggtcggacctggtggcgggcggcgttgttgaactgatcgacgccatggaggaggagaccctgatggtcgccatgacgccggaggacatcaagagtggcggctactgcgacacctacacccattgcgagatccatccggccatgattctgggcgtttgcgcgtccatcatcccgttcccggatcacaaccagagtcccagaaacacctatcagagcgccatggggaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcagtttcaacgaactgccggccggcatcaacgccattgtggccatcctctcctacggcggctacaaccaagaggactcggtgatcatgaaccagtcgggcattgaccgtggcctgttccgctcggtgttctaccgctcctaccgcgacaacgaggccaacattgacaacgtgaacgaggagctgattgagaagccgacgcgcgagaaatgcanaggnatgcgccacgctctgtacgacaaactggacgaggacggcatcagctcaccgggcacgcgcgtttcgggcgacgacgtcatcatcgggaaaaccattgccattccggaaattgagaacgagttggaggccagcgccgcacgctaccagaagagagatgcgtccactttcttgcgcagcagtgagacgggcatnnntnntcaggtnatgatcacgctgaactcggagggcaacaagttcgtcaaaatccgcgtccgctccatccggctgccccaaatcggcgacaaatttgcctcgcgccacggccagaagggcacaatggggatgatgtaccgcgaggaagacatgccattcaccnnngaggggatcaccccggacatcatcatcaatccgcacgcggtgcccagccggatgaccattggccacttgattgagtgtttgcaggganagntgtccgccaacaagggcgaaatcggcgacgccacccccttcaacgacaccgtgaacgtgcagaagatccaaaccctgttggccgagtacaactaccacctgcgcggcaacgagatcatgtacaacgggttcaccgggcagaagttgacaactcaggtattcattggtccgacctactaccagcgcnnnaaacacatggtggacgacaaaattcattctcgcgcgcgcggaccaattcaaggcatgaatcggcaaccgatggagggaagagctcgngacggcggcctgcgcttcggcgagatggaacgcgactgccaaatctcgcacgggtgtgcccagttcctgcgcgagcgtctgttcgaagtgtccgacccgtacctggtctacgtgtgcaaccagtgtgggctcatcgtcatcgccaaccagcgcacgaacacatttgagtgcaagnnnnnnnnngacaaaacccaggtgtccgcagtgcgcatcccctacgcttgcaaactgctcttccaggagctgatgtccatgtcgattgcgccgcgcatgatggtgaagnnnnnnnnnnnnnnnnnnnnnnnnnnnnnnnnnnnnnnnnnn

SEQ ID NO: 148 - DNA, 2124 bp, Artificial Sequence
  Description of Artificial Sequence: Synthetic polynucleotide
  modified_base (1)..(126): a, c, t, g, unknown or other
  modified_base (285)..(285): a, c, t, g, unknown or other
  modified_base (289)..(289): a, c, t, g, unknown or other
  modified_base (306)..(306): a, c, t, g, unknown or other
  modified_base (342)..(342): a, c, t, g, unknown or other
  modified_base (345)..(345): a, c, t, g, unknown or other
  modified_base (360)..(360): a, c, t, g, unknown or other
  modified_base (399)..(399): a, c, t, g, unknown or other
  modified_base (408)..(408): a, c, t, g, unknown or other
  modified_base (420)..(420): a, c, t, g, unknown or other
  modified_base (426)..(426): a, c, t, g, unknown or other
  modified_base (438)..(438): a, c, t, g, unknown or other
  modified_base (444)..(444): a, c, t, g, unknown or other
  modified_base (465)..(465): a, c, t, g, unknown or other
  modified_base (468)..(468): a, c, t, g, unknown or other
  modified_base (496)..(496): a, c, t, g, unknown or other
  modified_base (499)..(499): a, c, t, g, unknown or other
  modified_base (501)..(501): a, c, t, g, unknown or other
  modified_base (591)..(591): a, c, t, g, unknown or other
  modified_base (733)..(733): a, c, t, g, unknown or other
  modified_base (922)..(972): a, c, t, g, unknown or other
  modified_base (1123)..(1146): a, c, t, g, unknown or other
  modified_base (1309)..(1575): a, c, t, g, unknown or other
  modified_base (1720)..(1890): a, c, t, g, unknown or other
  modified_base (2044)..(2124): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctcaaacaaatcctgaacctgaaccaaccgctggccaccacactggctaatgaacctgtttggaaattgctgattttcgactcctacggccaagacatcctttccccactgctcagcgtgaagcaactccgtgaactgggcgtcactttgcatttnttgntggaatccaagcgtganagcctcccggacgtgccggccgtctactttgttgcnccnaccgagaagaacatncgcatcatttgcagcgacctgaagaacgcgctctacganagcttctanctgaacatgatntacccnctgcccagaccnctgctngaggacttggcccaaagtgcngtngcgggtggaagtgtgcaacaagtgcaanagntnaccgatcaattcctctcattcatctcactggaagaggacctcttcatgcttggccgctacacttcccacagtccattctcatttttttcnatcaacgacccatcggcaagtgcggaccaaattgaggcaatcattgggaagattgtgaatgggttgtttgcggtttgtgtcacgctgggcgtcatcccgatcatcaagtgtccgaagaacaatgcggcggaacgagtggctnagaaattggaccaaaaaatccgcgacaatctgcgcgatgcccgcaacaatctgttcgtccaagaaagtgtgcgcgccggccacctgaacatccaccggcccgttctggtgattgccgaccggggcattgatttgtccaccatgttgcaccacacttggacctaccaggccatgattgctgacattttgnnnnnnnnnnnnnnnnnnnnnnnnnnnnnnnnnnnnnnnnnnnnnnnnnnnaagcccaaggactttgagttcagcggggaggacaagctgtggagtgcctacaagggcagccccttcccgctggtggccgaggcaatccaggaggacttggaggcctaccgcaagaatgaggaggaaatcaagcggctcaaggactccatgnnnnnnnnnnnnnnnnnnnnnnnngccgacggacgagtcggattcctgctgggcagtgccaccaacaagctgtcaaccgcggtgggcaacctgcccgaactgctggaaaagaagcggctcatcgacttgcacaccagcgtggccaccgccctgctggacaacatcaaggcacggaagctggacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgggcacaccgaactccacctgggggccggcacaaaaacagtgggcatgttctccaaactgctcagccagagctccaagttcgtcatggagggagtgaagaatttggtgcccaagaagcataatttgccattgacaaaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccggccgccgacgtcattgtgtttgtgattggcggcggcaattacgtggagtaccaaaatgtgcaggagtgggcacggtccaaggggctccagcgaatgacctatggatgcaccgagatggtcagcccaaagaattttgttgagcaggttnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 149 - DNA, 2226 bp, Artificial Sequence
  Description of Artificial Sequence: Synthetic polynucleotide
  modified_base (1)..(51): a, c, t, g, unknown or other
  modified_base (270)..(270): a, c, t, g, unknown or other
  modified_base (509)..(509): a, c, t, g, unknown or other
  modified_base (514)..(514): a, c, t, g, unknown or other
  modified_base (516)..(521): a, c, t, g, unknown or other
  modified_base (576)..(576): a, c, t, g, unknown or other
  modified_base (621)..(621): a, c, t, g, unknown or other
  modified_base (645)..(645): a, c, t, g, unknown or other
  modified_base (732)..(732): a, c, t, g, unknown or other
  modified_base (892)..(892): a, c, t, g, unknown or other
  modified_base (894)..(894): a, c, t, g, unknown or other
  modified_base (1146)..(1146): a, c, t, g, unknown or other
  modified_base (1149)..(1149): a, c, t, g, unknown or other
  modified_base (1456)..(1467): a, c, t, g, unknown or other
  modified_base (1506)..(1506): a, c, t, g, unknown or other
  modified_base (1737)..(1737): a, c, t, g, unknown or other
  modified_base (1863)..(1863): a, c, t, g, unknown or other
  modified_base (1960)..(2226): a, c, t, g, unknown or other
nnnnnnnnnnnnnnnnnnnnnnnnnnnnnnnnnnnnnnnnnnnnnnnnnnngtcttcgagtgcaatccccaggagactgccacttttgtgcgcatctcccgggctcggctggacggcaccccgttggtggtgtccacggctggccacgacctgacctgctcccagtactgccgcaacaacattgagccaaccacgggcgcccagcgactctgcgcctccttcaactttgatggccgcgagacttgctacttcttcgatgatgcggctccnccagcgggcacagccgaactgaacccgaatccgtcggcgaacaacttctactacgagaagacctgcctgccagcggtgaatgcccacgaggcgtgctcctaccgctccttctcctttgagcgcatccgaaagactgccctcgagggttttgtgaagaaaagcatccaggtggccaaccgcgagcaatgcctgagtgcgtgtctgaaggagcgcgagttcgtgtgccgttccgtcaactncaacnannnnnngtacgcttgcgagatgagcaccgaggacaggcggtccaagcccacgaatctgcgnatgactgaccagattgactacttcgacaacaattgcctcaacgcncaaaaccgttgcggcctgcagggnggcaacttggttttcgtgaagaccacccagttcgagatcaaatactacgaccacacacagtcggtggagccgcaggagtcgaattgnctgcagaagtgtctggactcgctgaacactttctgccgttccgtggaattctcgccgcacgagaagaattgcattgtcagcgatgaggacaccttctcgcgtgccgaccaacaggcggcggtccagagcaaggactactacgagccgatttgcgtttccncngatttgtcttcctccacgtgccgtcagcaagcggcattcaaccgcttcattggcgtctccattgaaggccaaccggtggccactgcccagggcgtcaccgtgtccgactgcatctcgctgtgcttccaaaacctgaactgcaagtccatcaactatgaccgcacccaaagcacctgctacatcttcgctattggccaggcgaatgccaacgtgaagaagaacccatcagtggacttttatgaattcaattgngantcccaattcggcggaatggccctttgcaccaacgatggcattcgcttcattgtgaacaccaaagagccctacacgggtgccatttatgcagccgagaagttcagcacgtgctcgcaagtggtggaaaatgccaagcaaatttccatcactttcccgccgccgaatgtgtcgcccaactgcggcaccacaatcaaagatggcaagctggaagcgttggtggttgtgtcgctggacggggtgatgccccaccaagtcacaaccgagtgggaccgcttctaccgagtttcttgcgacgtgaacatggacnnnnnnnnnnnngagggcaccgttgttgtcaccacaatcttcgagacaaangaagcggagccccaagtgcttgatgctggcactccaccacccataactgctgccctctccttcctggatgccgaagagcaaccactgcagaaagcatccatcggtgatccgatcaaattggtggtgcacagtgagcaggccggtccgcacaacatgatgctgacggagtgcacggcaactcgggtgggcggtgaaggcgaggccgtgccattcacaatcattgacaacggntgcccacgctatcctgcccttgttggccccgtggagccggactttgacaagaaccgtttgcgggcggacatgaaggcgttccgactggacggctcctatgacgtgcagatccagtgcacaattatnttctgcgcaggcccgaacggatgtccaccgagcaattgcttggattccggcacaaacgatcttttcttgtcccatggtcgacgaaaacgacacgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 150 - DNA, 2331 bp, Artificial Sequence
  Description of Artificial Sequence: Synthetic polynucleotide
  modified_base (1)..(12): a, c, t, g, unknown or other
  modified_base (72)..(72): a, c, t, g, unknown or other
  modified_base (102)..(102): a, c, t, g, unknown or other
  modified_base (111)..(111): a, c, t, g, unknown or other
  modified_base (177)..(177): a, c, t, g, unknown or other
  modified_base (180)..(180): a, c, t, g, unknown or other
  modified_base (207)..(207): a, c, t, g, unknown or other
  modified_base (210)..(212): a, c, t, g, unknown or other
  modified_base (216)..(216): a, c, t, g, unknown or other
  modified_base (219)..(219): a, c, t, g, unknown or other
  modified_base (222)..(222): a, c, t, g, unknown or other
  modified_base (228)..(228): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (264)..(264): a, c, t, g, unknown or other
  modified_base (274)..(435): a, c, t, g, unknown or other
  modified_base (505)..(507): a, c, t, g, unknown or other
  modified_base (915)..(915): a, c, t, g, unknown or other
  modified_base (982)..(984): a, c, t, g, unknown or other
  modified_base (1066)..(1066): a, c, t, g, unknown or other
  modified_base (1072)..(1074): a, c, t, g, unknown or other
  modified_base (1143)..(1143): a, c, t, g, unknown or other
  modified_base (1198)..(2331): a, c, t, g, unknown or other
nnnnnnnnnnnnggaattgattttggtaatatgaactgctatttggctgtggccagaaacaagggcatcganattctcatcaacgactattcacttcacgcnacaccttcntgtgtttcctttggtcaaaccaatcgtttgatgggattcggagccaagcagcaaatgaatgcccantanaagaacagcgtgctaaatttcaagcanttnnngggnaanaanttttcngacccngtngtncagaaattaattccatttgttccntgcaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccctatttcttcgatgaaaaccaacgtttggcactgatcaaggctggcaaaattgcgggtatcaatnnnttttacctgatcaatgaccattccgcacttgcctacaactatgggatgtacaaagcggaattaccgccagcggaagaatcaccgaaattggttgtttttgtggattgcggacactcggcggtacaaacaagtttggtcgctttcagtgctcagaaagcagaggtcatcggtgctgcccacgatttgagtgttggcggtctatactttgacgcacttatccgcgacgattttgccaaacaattcaagcagaaatacaaaattgatgtccgtcaaaatccacgcgcatggcttcgtttattagacgaatgcgaacggctgaaaaagcaaatgtccgcaaacagtcagccaattcctctcaacattgaatgcctcatgaatgatgtggacgtgaatgggagtatgcaaagngccgattttgaagaaatggccgagccattgttcaagaaacttgagcaattgctgcagagactgctcnnncaaacggctcgggttaagccggaacagattgctgatgtggaattgattggcgggtcgtccagagtgccgcgaatcaagcaantcattnnngaatttttcaaaaaggagccgcggacaaccatgaaccaagacgacgcggttgcacggggatgtgctctncgctgtgcaaccttttacccggcctacagaatgaaggagtatttggtggttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 151 - DNA, 1857 bp, Artificial Sequence
  Description of Artificial Sequence: Synthetic polynucleotide
  modified_base (1)..(30): a, c, t, g, unknown or other
  modified_base (231)..(231): a, c, t, g, unknown or other
  modified_base (237)..(237): a, c, t, g, unknown or other
  modified_base (243)..(243): a, c, t, g, unknown or other
  modified_base (249)..(249): a, c, t, g, unknown or other
  modified_base (252)..(252): a, c, t, g, unknown or other
  modified_base (255)..(255): a, c, t, g, unknown or other
  modified_base (264)..(264): a, c, t, g, unknown or other
  modified_base (273)..(273): a, c, t, g, unknown or other
  modified_base (284)..(284): a, c, t, g, unknown or other
  modified_base (333)..(333): a, c, t, g, unknown or other
  modified_base (357)..(357): a, c, t, g, unknown or other
  modified_base (399)..(399): a, c, t, g, unknown or other
  modified_base (432)..(432): a, c, t, g, unknown or other
  modified_base (444)..(444): a, c, t, g, unknown or other
  modified_base (453)..(453): a, c, t, g, unknown or other
  modified_base (459)..(459): a, c, t, g, unknown or other
  modified_base (490)..(490): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (513)..(513): a, c, t, g, unknown or other
  modified_base (519)..(519): a, c, t, g, unknown or other
  modified_base (561)..(561): a, c, t, g, unknown or other
  modified_base (588)..(588): a, c, t, g, unknown or other
  modified_base (612)..(612): a, c, t, g, unknown or other
  modified_base (624)..(624): a, c, t, g, unknown or other
  modified_base (648)..(648): a, c, t, g, unknown or other
  modified_base (661)..(661): a, c, t, g, unknown or other
  modified_base (683)..(683): a, c, t, g, unknown or other
  modified_base (685)..(685): a, c, t, g, unknown or other
  modified_base (687)..(690): a, c, t, g, unknown or other
  modified_base (1014)..(1014): a, c, t, g, unknown or other
  modified_base (1074)..(1074): a, c, t, g, unknown or other
  modified_base (1116)..(1116): a, c, t, g, unknown or other
  modified_base (1125)..(1125): a, c, t, g, unknown or other
  modified_base (1140)..(1140): a, c, t, g, unknown or other
  modified_base (1269)..(1269): a, c, t, g, unknown or other
  modified_base (1375)..(1377): a, c, t, g, unknown or other
  modified_base (1656)..(1656): a, c, t, g, unknown or other
  modified_base (1680)..(1680): a, c, t, g, unknown or other
  modified_base (1686)..(1686): a, c, t, g, unknown or other
  modified_base (1720)..(1720): a, c, t, g, unknown or other
  modified_base (1734)..(1734): a, c, t, g, unknown or other
  modified_base (1752)..(1752): a, c, t, g, unknown or other
  modified_base (1755)..(1757): a, c, t, g, unknown or other
  modified_base (1759)..(1759): a, c, t, g, unknown or other
  modified_base (1761)..(1763): a, c, t, g, unknown or other
  modified_base (1852)..(1857): a, c, t, g, unknown or other
nnnnnnnnnnnnnnnnnnnnnnnnnnnnnnctccaagatgcggccaaccgtatgcgtgtgtcctcaattgagcaaacttgcaagtcgaattccggacatccgacaagcagttgcagtgctgccgagatcatggccacgctgttcttttccgagatgaaatacgatgtgcagaatccgcgccatccagccgctgaccgtttcattctttccaagggccatgcttgcccaatnctctangcggcntgggangangcnggtttgctnagcaaagancaagtgctcantcttcgccgcattgactcggacattgagggacatcccactcctcggctnaacttcatcgatgttgcaaccgtntcccttggacaaggcctttcttgcgcggccggtatggcctangctggcaaatatgtggacaaggcttcctatcgngtctattgcctncttggaganggcganagtgcggagggatccgtttgggaggcagcangnttctcnagctantacaaactngacaanctggtggccattgttgacgtgaatcgcctgggccaaagccancaaaccatgctggaacatgatgtccanacctatgccaaccgctttgctgcntttggattccantccattgttgtggatggacatgangtgaacgcgctgntgaaggcttatgccgaagcaangnannnnaaagggaagcccaccgcaatcattgcaaagacattcaagggcaagggcattgagggtgccgagaatgaggacaattgccacgggaagccggtgaccatggataaggcggacaagattcgtgccctgttgaagagccaaaccccagtgaaatggaacattccaaagccggctggggacgcacaaaatgtggatcttggcattggccgcatcaagatgagctccccgcaatacaaagttggtgagaaagtcgcaacccgtcaggcttatggtgatgccttgctcaaattggcggatgtgaacaagcgagtcattgctttggattgngacatttccaactcgacattctcgaacaaagtgctcaagaagtacccggaacaattcgtncaatgcttcatcgccgaacagaacatggtgggcgttggcgtnggcatggcntgtcgaggacgtgcnattccacatattaggcacttttgccgcttcttcacccgtgccggcgaccaaattcgcatggctgctgtttcgttcgccaatgccaaattcactggttcccatgttggcgtgtcaattggagaggatggnccgagtcaaatgggcttggaagacttggctctgttccgtgccctgcccgacagcctggtgctctacccatcggacgcggtctcagcggaatacgccacggaattgnnngcgtcaactaatggcataacctacactcgcgtcagtcgtcccaacacgcccgtcatctatgccaacaacgagaagttcgaggtgggcaagtgcaaagtgcttcgacagtctgctgccgacaaagtgctgctgatcggtgccggtgtgaccctctatgagtgcatcaaggcccatgacatgttgagctcggcgggtaccaacgtggctgtgattgacctgttctccgttaagccaatcgacgtggaaaccctgtcgaaggaggcgcaacgcgttggtggnaaagttctgaccgtggaggaccantatcangccggaggaattggtgaggcggtagccatggctntggctgatctgccnaatgttcgtgtccgtagnctnnntntnnnagaattgccgcgctcgggcaaacccgaagaacttgtggagcactacgggatttccgccaagagcattgtggaggcggtgaagaactacnnnnnn

SEQ ID NO: 152 - DNA, 1377 bp, Artificial Sequence
  Description of Artificial Sequence: Synthetic polynucleotide
  modified_base (1)..(270): a, c, t, g, unknown or other
  modified_base (588)..(588): a, c, t, g, unknown or other
  modified_base (829)..(864): a, c, t, g, unknown or other
  modified_base (960)..(960): a, c, t, g, unknown or other
  modified_base (1014)..(1014): a, c, t, g, unknown or other
  modified_base (1069)..(1071): a, c, t, g, unknown or other
  modified_base (1183)..(1377): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcttccaatgactttttagcgtttgttggcaatcagcgaattgaggagatagcccagaaaacaatctccaaatatggtgttggcgcttgcggacctcgaaatttttacggcactgttgatgttcatttggacctggagcgggaattggccgaatttttgggttgtgaagaagccatattatacagctacgggtttgccacgattgcaagtgccattccggcctattcaaaacaaggggacatcatttttgccgacaaaggtgtcaattttgccattcaaaagggactggaagcgtcaaagagcagaattgttggntttgaccacaatgatatggttcatctagaaaagcttttggaggagcaagcagagcaagacagaaaaaacccaaggaaagcggcagccatccgccgcttcatggtggtcgagggactctacgcaaaaacagctaccatttgccagttgccacgtttgattgaattgaaatggaaatacaaagtgcgcatttttatggacgagtcatactcattcggtgtgctcggaaaacatggaaaaggtnnnnnnnnnnnnnnnnnnnnnnnnnnnnnnnnnnnngatctcgtttccgcaacacttgaaaatgcaatggccaccactggaggcttctgcgcaggccgatcatttgtgattggccaccaacggttgtctgcncttggctattgcttctccgcctcattaccaccacttttggcaacggcagcaatngaagctttgcgcatcattcaagagaaacctgaaatgtttggccaactcacaaaannntcggagcatttccatcaactgattcagaaggcaattgaaggcagcaaattcactttgattggagtcgaattatctcccataaaacacattggctacaaccatgaggaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 153 - DNA, 1623 bp, Artificial Sequence
  Description of Artificial Sequence: Synthetic polynucleotide
  modified_base (1)..(66): a, c, t, g, unknown or other
  modified_base (1102)..(1104): a, c, t, g, unknown or other
  modified_base (1272)..(1272): a, c, t, g, unknown or other
  modified_base (1399)..(1401): a, c, t, g, unknown or other
  modified_base (1621)..(1623): a, c, t, g, unknown or other
nnnnnnnnnnnnnnnnnnnnnnnnnnnnnnnnnnnnnnnnnnnnnnnnnnnnnnnnnnnnnnnnnnttcaaggatcgtgacaaaccagaaagtgtgcgaactagcaatatagtggcggccaaggctgtgtctgattcggtccgaacaagcctaggcccacgcggtatggacaaaatgatccaggcatcaaacggtgaggtgaccataaccaatgatggagccacaatcctcaatcaaatgtctgtcgtgcatccaaccgctaaaatgctcgtagaattgtcgaaggcacaggacatcgaggcgggagatggaacaaccacggttgttgttctggcaggttctttacttgacgcggccgagaagttgttggcaaaagatattcatccaaccacaatctccgattctttccgccgtgctgcggcctattccgagcaaatccttgaggatatggcaaccccgattgatctgaatgatgaggaggaattgaacaaattggcaacgaccagtctcaattcgaaggttgtctcccaacattcgcacattctggccccaatggccgtgcaagcggtcaaaaaattgatggcctcaccggaagagcagaacgtgaatctgaagatgataaagattgtgaagaagttgggagaaactgtcgacgagtcacagttgattgaaggcgcactcattgaacagaactcgatgggccatggcggaccaagtcgtatggagaaggcaaagattggactcatccagttccagatatctccgcccaaaaccaacatggagaatcaagtgatcatttcggattacacccaaatggaccgtgcgctgaaggaggaacgcaactacatcctcgagttgtgcaaacaaatcaaaaaggccggttgcaacgtgctgctcatccaaaagtccatcctgcgtgacgcaatcaacgaaatggcgcttcattttttcgccaaaatgaaaataatggtcatcaaggacattgagcgcgaagacatcgagttctactcaaaaatactcggctgtcgcccggtcgcttccgtggatcatttcacacccgagtcgcttggcaccgccgaccttgttgaggagattgaaaccnnngcggatggaaaagttgtcaaggttactggactcaagtcaagcgggaacgccgtgtccatcctcatccgtggctcaagcaagctggttcttgaggaggccgaccgttctctgcacgatgcactctgcgtcatccgctgtcttgtcaagaagcgggcattgctgccagtnggcggtgcacccgaaatggaagtctctgtaaaactccggcaagcagcacaaacaaaacagggagctgagcaatattgttggaaggcattcgcggaagctctggagctgatcccatacacactggccnnnaatgctggactttcacccattgggacggtgaccgagttgcgcacccaacatgcaaatggcaacaaagacttcggggtcaatgttcgaacgggagcggttacaaacattttggaggagaatgtggtccagcctttgctggtcacctcttttgcaatcaagcaggcggccgaatgcgtgcgtgccatcctgaagatcgatgatgttgtgctggcagtgcgtnnn

SEQ ID NO: 154 - DNA, 1788 bp, Artificial Sequence
  Description of Artificial Sequence: Synthetic polynucleotide
  modified_base (1)..(90): a, c, t, g, unknown or other
  modified_base (274)..(300): a, c, t, g, unknown or other
  modified_base (505)..(507): a, c, t, g, unknown or other
  modified_base (744)..(744): a, c, t, g, unknown or other
  modified_base (747)..(751): a, c, t, g, unknown or other
  modified_base (753)..(753): a, c, t, g, unknown or other
  modified_base (952)..(960): a, c, t, g, unknown or other
  modified_base (1065)..(1065): a, c, t, g, unknown or other
  modified_base (1067)..(1067): a, c, t, g, unknown or other
  modified_base (1071)..(1071): a, c, t, g, unknown or other
  modified_base (1075)..(1078): a, c, t, g, unknown or other
  modified_base (1328)..(1329): a, c, t, g, unknown or other
  modified_base (1331)..(1333): a, c, t, g, unknown or other
  modified_base (1335)..(1336): a, c, t, g, unknown or other
  modified_base (1338)..(1339): a, c, t, g, unknown or other
  modified_base (1341)..(1342): a, c, t, g, unknown or other
  modified_base (1344)..(1350): a, c, t, g, unknown or other
  modified_base (1353)..(1353): a, c, t, g, unknown or other
  modified_base (1594)..(1605): a, c, t, g, unknown or other
  modified_base (1732)..(1788): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaagatcaacagcagcaacgcatgggctcccaaatggcttactcctttgactcaaccgcactggagagagctgcccaggcggccaagacgttggagtcctcgtcgaatgccaagcaggcgcttgaattgagccggttgcaggagaccaccaagcacaaggagttggaagtgcagcagaagnnnnnnnnnnnnnnnnnnnnnnnnnnnaagccgaaaaatgtgcgagttgcagaggaggagcgccggaaaaccctggtggaagagaccaagcattcccgggctcgagccgagtaccaagaccaactggcacgcaaacgccaagaggaggagatggccatgaaggcacggatgcaggaggagtcgttgaggaagcaggaggagtctgtcaagaagcaggaggccattcggaaannnaccattgagcacgagctccaaatgcgccacaagctggacctggagcgcatccaagccgaggtgcaggccaaaaccaaggcggcccgcgagaaccgggacgtgaacctggaaatgatgaaggccagcgaggaggagcgccgcaaaacgctggttgagcagatccggacgacgggcagtgtgctgggcgccggactgcaggagttcatctccgaccgcaccaaaattgcatctgctgtnggnnnnntnaccgtcctcgccgttggctggtactcggccaaacgtggcacagccgtggtggccaagtacgtggaggcccgactggggaagccctcgctggtgcgcgaaacatcccgcctgacgcccatcgagttgttcaagcacccggtggtcagtgcaaagcaattgttccgccgaggggaggacccgctcaaaggcattgttttgnnnnnnnnnctggagtcccaactgcgcgacatcgccatcaccacccgaaacaccaagcgcaactttggcctgttccgaaatgtgctcttttacggcccgcctggcactgggaanancatntttnnnnagagtctggcccgccactccggcctcgactacgccatcatgacgggcggcgacgtggccccgatgggccgggacggcgtctcggcggtgcacaaaatcttcgactgggccgaaacctcacggaaaggcctggtactgttcatcgacgaggccgacgcttttctgcgcaaacgcagcacagagcacatcagtgaggacatgcgggccacgctgaatgccttcttgtatcggaccggggagcagtcaagganntnnntnntnntnntnnnnnnnaancagcccgaacaattcgactgggccgtcaacgatcgtctggacgaactggtggaatttgagctgcccggtgagaaagagcgtgaacgcatcctgctccagtacttcaagcagtacatcgccgacccggccacctcgggggcaaggaagcagcggctgaagttgggcaacttcgagtggattcccaagctgaaggagattgccaaacgggcggagggaatgtctgggcgggagctgtccaaannnnnnnnnnnntttcaggccagtgcctacgcctcggaagatggcgtcctgacagccgaaatgattgaccagaacacggcggaagtgctgaagcagcatcggcgcaaaatggaatggctggcagccgagcgggcaaagnnnnnnnnnnnnnnnnnnnnnnnnnnnnnnnnnnnnnnnnnnnnnnnnnnnnnnnnn

SEQ ID NO: 155 - DNA, 1491 bp, Artificial Sequence
  Description of Artificial Sequence: Synthetic polynucleotide
  modified_base (1)..(78): a, c, t, g, unknown or other
  modified_base (301)..(588): a, c, t, g, unknown or other
  modified_base (615)..(615): a, c, t, g, unknown or other
  modified_base (626)..(630): a, c, t, g, unknown or other
  modified_base (632)..(633): a, c, t, g, unknown or other
  modified_base (635)..(641): a, c, t, g, unknown or other
  modified_base (643)..(644): a, c, t, g, unknown or other
  modified_base (647)..(651): a, c, t, g, unknown or other
  modified_base (653)..(654): a, c, t, g, unknown or other
  modified_base (669)..(670): a, c, t, g, unknown or other
  modified_base (672)..(672): a, c, t, g, unknown or other
  modified_base (690)..(690): a, c, t, g, unknown or other
  modified_base (732)..(732): a, c, t, g, unknown or other
  modified_base (768)..(768): a, c, t, g, unknown or other
  modified_base (783)..(783): a, c, t, g, unknown or other
  modified_base (792)..(792): a, c, t, g, unknown or other
  modified_base (801)..(801): a, c, t, g, unknown or other
  modified_base (804)..(804): a, c, t, g, unknown or other
  modified_base (810)..(810): a, c, t, g, unknown or other
  modified_base (813)..(813): a, c, t, g, unknown or other
  modified_base (843)..(843): a, c, t, g, unknown or other
  modified_base (927)..(927): a, c, t, g, unknown or other
  modified_base (1194)..(1194): a, c, t, g, unknown or other
  modified_base (1386)..(1386): a, c, t, g, unknown or other
  modified_base (1489)..(1491): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnttccagagcaatgagttggcaaaagagcttgggattgaccaccaaaaattgattggcgctgtgaaaagcttgcaaacccatgatgggataatcaacgtgaaggatatgaagatcaagcggttggaattgacggcggaaggcgaacaagttctggcaaatggctcccatgaatacaacctttacaagctggttggtgaaaatggagtgcccaaggcgataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgcagtggctcatggcgtgacaancaattcaaaannnnnanntnnnnnnnannggnnnnncnnccgcccagcggccanntncatccgctgctgaaggtncgatccgagttcagggacattttcttccaaatgggcttctcngagatgccaaccaatcgttttgtggaatcctccttntggaactttgacgcnctcttccanccgcaacancanccagcnagngattcccatgacactttcttcctttctggnccagcaatatcgacagaatttccggaggattacctggaacgtgtgaagaaggttcattccgagggtggctatgcttccattggntatcaatacgattggaaattggaagaagcgcaaaagaatgtgctcagaacgcacaccaccgccgtctcagcccgtcaactttacttgctggcacagagtgacttcaaacccgccaaaatgttcagcattgatcgggtgttcagaaatgaaacgttggatgccacccacttggccgagttccatcaagtcgagggcgtagtcgccgaacgaaatctctctctggcgcatgtcattggactgttcacggagttcttcaggaaatgcganattgaaaacttgcgcttcaagccaacctacaacccctataccgaaccttcaatggaaatattcgcatatcatgaggggctgaagaaatgggtggaaattggcaactcgggcatgttccggccagaaatgcttctgcccatgggattgcctgaggatgttgctgtcgctggctttgggctttcattggagagnccaacaatgatccgctacgggctctccaacattcgcgaactctttggccacaaaattgacttgcagatggtctacaacaacccgatttgccaattggacaagnnn

SEQ ID NO: 156 - DNA, 1668 bp, Artificial Sequence
  Description of Artificial Sequence: Synthetic polynucleotide
  modified_base (1)..(357): a, c, t, g, unknown or other
  modified_base (646)..(1044): a, c, t, g, unknown or other
  modified_base (1053)..(1053): a, c, t, g, unknown or other
  modified_base (1080)..(1080): a, c, t, g, unknown or other
  modified_base (1101)..(1101): a, c, t, g, unknown or other
  modified_base (1110)..(1110): a, c, t, g, unknown or other
  modified_base (1137)..(1137): a, c, t, g, unknown or other
  modified_base (1146)..(1146): a, c, t, g, unknown or other
  modified_base (1170)..(1170): a, c, t, g, unknown or other
  modified_base (1176)..(1176): a, c, t, g, unknown or other
  modified_base (1219)..(1668): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcccaaatcgaggtgataccatgcaaagtttgcggcgacaagtcgtctggggttcactacggtgttatcacatgcgaaggatgcaagggatttttccgacgttcccagcagggcccaaccaactaccaatgtgcgcggcaacggaattgcgtcgttgaccgcgtcagccgcaaccgttgccaatactgtcggctgaagaagtgcatggaacttgggatgagcagggaagccgtcaaatttggacgcatgagcaaaaagcaacgcgagaaggtcgaggatgaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgaacngatggatggctgaaattcgccaagganttgaccgaaataatccggtgnatcattgantttgccaaggccatcaagggcttccangagttgaancaggatgaccagatccaggcactnaagcanacaacctttgtgctctccctgattgccattgcgcaggtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 157 - DNA, 555 bp, Artificial Sequence
  Description of Artificial Sequence: Synthetic polynucleotide
  modified_base (1)..(51): a, c, t, g, unknown or other
  modified_base (67)..(67): a, c, t, g, unknown or other
  modified_base (102)..(102): a, c, t, g, unknown or other
  modified_base (168)..(168): a, c, t, g, unknown or other
  modified_base (502)..(555): a, c, t, g, unknown or other
nnnnnnnnnnnnnnnnnnnnnnnnnnnnnnnnnnnnnnnnnnnnnnnnnnngcgctaaccatccagntaatccagggccagttcatcgaggagtacgacccnaccattgaggacagttatcgcaaacaggtactaattgacggcgagacctgtttgttggacattctngacacagctggccaggaagaatattcggccatgcgcgaccagtacatgcgcaccggtgagggcttcctgctggtgtttgcgctcaatgagtacaaatccttcgaaaacatccatgcatatcgtgaacaaatcaggcgggtcaaagacagcgacgaggtgcccatggtgctggttggcaacaagtgtgacctgcaacagcgcgccatagaacaacgaagcatccaggaattggcccgttcattcggcattcccttcatcgaaacgtcggcaaagacgcgaaaacacgtggacgaggcattccatgcacttgtacgcgagatcaggaagcataagnnnnnnnnnnnnnnnnnnnnnnnnnnnnnnnnnnnnnnnnnnnnnnnnnnnnnn

SEQ ID NO: 158 - DNA, 1392 bp, Artificial Sequence
  Description of Artificial Sequence: Synthetic polynucleotide
  modified_base (1)..(183): a, c, t, g, unknown or other
  modified_base (255)..(255): a, c, t, g, unknown or other
  modified_base (517)..(672): a, c, t, g, unknown or other
  modified_base (793)..(858): a, c, t, g, unknown or other
  modified_base (939)..(939): a, c, t, g, unknown or other
  modified_base (1390)..(1392): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatattatggaagtggaaggcccggcatttgctgaatcaatatcggagggggacatccgatggcagaaaaangttggcgattttgtcaaatcagatgaaattgtggcagaaattgagactgataagacttccgttgaagtgcctgcaccatttgaagggaaaattgttgagctgctagttgaagacggtgccaaagtcacggctcggcaaaagttgtataaattggagaagggcgctgaagcgggtggaaaacctgcgggcgaaacgccacagaagcaggccgaaactaaggtgaaggaagcacctccacaaccgccgaaacaagagccgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacaaacaataaccggggcacgcaccgaaactcgggtgaaaatgaaccgaatgcggcagcgcattgccgagcgacttaaggaggcacagaacacgaacgccatgctgaccacattcaacnnnnnnnnnnnnnnnnnnnnnnnnnnnnnnnnnnnnnnnnnnnnnnnnnnnnnnnnnnnnnnnnnnggcgttaaactcggcctcatgtccccgtttgtgcgcgcttcggccattgcactgcaggaattgccggttgtgaatggaggnattgagggcaccgaaatcgtctatcgcaactatgtggacatttccattgcggtggccactccacggggccttgtggtgcccgtcctcagaaatgtggaatcgctgagctattcgggcattgagaaaatgttgggcgaactcggagtcaaggctcgagacaacaaactggccattgaggacatggagggcggcacattcaccatcagcaatggcggcgtcttcggctcattgtttggcacgccaattatcaacccgcctcagtccgcaattcttgggatgcatggaattttcgaccggccggttgctgttgatgggaaggtggaaattcgcccaatgatgttcgtcgcactgacttatgaccaccgactcattgatggcagagaggcggtcacctttttgcgcaaaatcaagcaagccgtggaggacccgttgaccattatgctcgaccttnnn

SEQ ID NO: 159 - DNA, 1968 bp, Artificial Sequence
  Description of Artificial Sequence: Synthetic polynucleotide
  modified_base (1)..(99): a, c, t, g, unknown or other
  modified_base (385)..(390): a, c, t, g, unknown or other
  modified_base (582)..(582): a, c, t, g, unknown or other
  modified_base (672)..(672): a, c, t, g, unknown or other
  modified_base (1020)..(1020): a, c, t, g, unknown or other
  modified_base (1290)..(1290): a, c, t, g, unknown or other
  modified_base (1426)..(1968): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgacgagtacatgcagaaatgtggactctttgagagcaccgcagacatgcaaaggcgactcgaggttttgcgccgaatcaatgccatggtgaagaaatgggtgaaggaggtttcacaggagaaggttccacccgaccagttggagaccgtcggtggcaagctgttcacatttggctcttaccgacttggtgttcatacccccggtgctgacattgattcgctgtgcgtggttccgcgacacattgatcgcaccgatttcttcgcttcattttatgaaaaactannnnnngatgaaaacacaacggatttgcacaaagtggaggatgcattcgttccggtgatcaagttgcgctacagcggcatcgatctggacattcttttcgcgcggttggcactcaaggaggtggccgatgatcagcagttgacggacgacaatttgttgcgcaatttggacgagaaaagcattcgctcattgaatgtntgccgagttgctgacgaaattcttcgactaattcccaaccatcggaatttcatcgttacccttcgcgcagtcaaactttgggccaaaatncatggcatttactcgaatgtcctcggctttctgggcggcgtcgcatgggcaatcctggtggcgagaacctgtcaactgtatccaaatgcagcacccgctgtactgcttgagaagttcttcctggtgttctcccaatgggaatggccgcatccggtaattctgaaagatgcggacacgccgcgcgttgatatgccctactttgtggacatgatctgggatccgcgcacccgtgtttccgaccgctaccacctaatgcccatcattacaccggcattccctgaacaaaattccactttcaatgtgaccaagtcgacacgtcaagtgatgacaaacgagttcaaagaagcnctgaacacaatgatcgaaatcacaaaaggcgaggccggttgggacaaactcttcgaggagatcaacttcttcacgcgctacaaacacttcattgccctgctctgtgtgacggccgatgaagaggaccatctcattttcagtggattggtcgagtccaaaattcgccatttggtcgcttccctggagcgcaacccgtgcgtggcgttgtgccatgtcaatccaaggcagtacaaaccaatcgacaccaaggatctcgagattgaatatganaatcccgtctgcaccctttggttcattgggctcgagttcttgcaacgaagcatgaacatcaacctgaccgaggagattcaggcgtttgtgtccaacgtctacttgagcgcgtccgcaatgaaggacttcaagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 160 - DNA, 387 bp, Artificial Sequence
  Description of Artificial Sequence: Synthetic polynucleotide
  modified_base (1)..(24): a, c, t, g, unknown or other
  modified_base (283)..(283): a, c, t, g, unknown or other
  modified_base (285)..(285): a, c, t, g, unknown or other
  modified_base (287)..(287): a, c, t, g, unknown or other
  modified_base (289)..(293): a, c, t, g, unknown or other
  modified_base (385)..(387): a, c, t, g, unknown or other
nnnnnnnnnnnnnnnnnnnnnnnncaggcatatcctttggccgatattcagctatcgcagaaattgcttgacattgttcagcaagctctaaactatcatcaactgaagaaaggtgcaaatgaggcaacgaaaacattaaatcgtggaatttccgagctgattgtcttggcagctgatgccgagcctcttgagatcattctgcacttgccgcttctctgcgaggacaagaatgttccatatgtgttcgtgaaaagcaaagcggctctgggacgtgcttgcggtntnancnnnnnggtcgttgctgcttcaatcacgcagaatgaaggctcacagctgaagtcacaaattcagaagattaaggaagatgttgagaagctgctcatcnnn

SEQ ID NO: 161 - DNA, 2490 bp, Artificial Sequence
  Description of Artificial Sequence: Synthetic polynucleotide
  modified_base (63)..(63): a, c, t, g, unknown or other
  modified_base (219)..(219): a, c, t, g, unknown or other
  modified_base (228)..(228): a, c, t, g, unknown or other
  modified_base (300)..(300): a, c, t, g, unknown or other
  modified_base (303)..(303): a, c, t, g, unknown or other
  modified_base (306)..(306): a, c, t, g, unknown or other
  modified_base (327)..(327): a, c, t, g, unknown or other
  modified_base (337)..(337): a, c, t, g, unknown or other
  modified_base (345)..(345): a, c, t, g, unknown or other
  modified_base (357)..(357): a, c, t, g, unknown or other
  modified_base (367)..(367): a, c, t, g, unknown or other
  modified_base (378)..(378): a, c, t, g, unknown or other
  modified_base (391)..(411): a, c, t, g, unknown or other
  modified_base (427)..(427): a, c, t, g, unknown or other
  modified_base (432)..(432): a, c, t, g, unknown or other
  modified_base (435)..(435): a, c, t, g, unknown or other
  modified_base (441)..(441): a, c, t, g, unknown or other
  modified_base (458)..(458): a, c, t, g, unknown or other
  modified_base (465)..(465): a, c, t, g, unknown or other
  modified_base (483)..(483): a, c, t, g, unknown or other
  modified_base (489)..(489): a, c, t, g, unknown or other
  modified_base (829)..(831): a, c, t, g, unknown or other
  modified_base (969)..(969): a, c, t, g, unknown or other
  modified_base (1021)..(1023): a, c, t, g, unknown or other
  modified_base (1154)..(1154): a, c, t, g, unknown or other
  modified_base (1534)..(1551): a, c, t, g, unknown or other
  modified_base (1762)..(2490): a, c, t, g, unknown or other
atggccaacgttgtggaggtggctattgagaagattgatgaggtgaagtcgcggcttggcagnaccctgggcgcctcaatgcggctgcgtgatctgatccgacaggttcgagcggcacgcacggcggcagaagagcgagctgtggtggagagggaaagtgcaaacatcagggactcgtttcgggatgaagacaacaagtacaagtgcagaaacatggcnaagctgctntacatccacatgctcggctaccaagcccactatggccaagtggagtgcgtcaaactggtgggcgagaagcgnttnacngacattcgcatcggctacctnggcgcaatgntgctgctngatgaacgttcngaaatccacntgttggtgacnaactgcttgaaannnnnnnnnnnnnnnnnnnnncaattcgtggccggcntggcnctntgcacncttggctccatttgctnggagganatgtgcaaagatttggcngctgangtggaaaaactgctcaagtccaccaacacgtacatcaagaaaaaggccgcactttgcgcgttccgaattgtgcgaaaagtgcccgaactgattgagatgttcatttcaagcacgcgcgctctgttgaatgagaagcaccatggggtgttgatggccggtgtcacgctggtgtcggaaatgtgcgagcggagtgtggatgtgcgaacgcattttaaaaagatggtcccaaacctggtgcgaatcctgaagaatttgctgatgaccggctactcgcccgagcatgatgtgtccggcataagcgatccattccttcaagtgaaaatcctaaaattgctccgannnttgggccgtgacgaccccaaggccagtgaggagatgaacgacatcctggcccaggtggccaccaacacggagacctccaagaatgtgggcaatgcaatcctgtatgagaccgtgttgacaatcatggaaattaagagngaaagtggcctccgtgttctggccgtcaacatcctcggacgtttcctcctannnaccgacaaaaacattcgctatgttgcgctgaacacacttctcaaaacggtgggcatcgactttcaagcagtgcaacggcacaggaccaccgtggtggagtgtctgaaggatgccgatgtttccatcaaaanacgcgccctggaactctgctttgccctgatcaaccaaacaaacattgtgagcatgtccaaggagatcatcattttcctggaaagcgccgatgcggagttcaaggcggaatgcgcctcaaagatgtacgtggccacggagcgcttctcgcccagcttggtgtggcacttggacacaatggtcaatgtgttgcaattagccggcaaccatgtcccagacgaagtggtcagcgccatgatccaactgatttcctcccaacccgagctccaaacctacgccaccatccaaatgttccacgccgccgagcgcgaaatcatcaacgcgcagcccctgttgcaagttgccttctggtgcattggcgagtttggggatttgctgattnnnnnnnnnnnnnnnnnntcatttcagatagaagaatcggaagtggtggaaatcttcgaacggctgctgccctcctccctgatgaccattgccagccgcgaattcggcctcaccgcactggccaagctggtcacccgtttcgagagctgcgccgaacgcatccatgccctcatccgctgctatactgcccacatgaatttggagttgcagcagcggtcggtggagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 162 - DNA, 4608 bp, Artificial Sequence
  Description of Artificial Sequence: Synthetic polynucleotide
  modified_base (1)..(3): a, c, t, g, unknown or other
  modified_base (94)..(96): a, c, t, g, unknown or other
  modified_base (145)..(145): a, c, t, g, unknown or other
  modified_base (147)..(148): a, c, t, g, unknown or other
  modified_base (150)..(150): a, c, t, g, unknown or other
  modified_base (201)..(201): a, c, t, g, unknown or other
  modified_base (231)..(231): a, c, t, g, unknown or other
  modified_base (264)..(264): a, c, t, g, unknown or other
  modified_base (283)..(284): a, c, t, g, unknown or other
  modified_base (287)..(288): a, c, t, g, unknown or other
  modified_base (291)..(291): a, c, t, g, unknown or other
  modified_base (293)..(293): a, c, t, g, unknown or other
  modified_base (295)..(298): a, c, t, g, unknown or other
  modified_base (300)..(300): a, c, t, g, unknown or other
  modified_base (345)..(345): a, c, t, g, unknown or other
  modified_base (353)..(357): a, c, t, g, unknown or other
  modified_base (360)..(360): a, c, t, g, unknown or other
  modified_base (368)..(382): a, c, t, g, unknown or other
  modified_base (385)..(388): a, c, t, g, unknown or other
  modified_base (391)..(394): a, c, t, g, unknown or other
  modified_base (396)..(396): a, c, t, g, unknown or other
  modified_base (411)..(411): a, c, t, g, unknown or other
  modified_base (483)..(483): a, c, t, g, unknown or other
  modified_base (496)..(496): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (511)..(513): a, c, t, g, unknown or other
  modified_base (549)..(549): a, c, t, g, unknown or other
  modified_base (555)..(555): a, c, t, g, unknown or other
  modified_base (621)..(621): a, c, t, g, unknown or other
  modified_base (636)..(636): a, c, t, g, unknown or other
  modified_base (648)..(648): a, c, t, g, unknown or other
  modified_base (651)..(651): a, c, t, g, unknown or other
  modified_base (663)..(663): a, c, t, g, unknown or other
  modified_base (678)..(678): a, c, t, g, unknown or other
  modified_base (682)..(682): a, c, t, g, unknown or other
  modified_base (684)..(684): a, c, t, g, unknown or other
  modified_base (693)..(693): a, c, t, g, unknown or other
  modified_base (723)..(723): a, c, t, g, unknown or other
  modified_base (732)..(732): a, c, t, g, unknown or other
  modified_base (735)..(735): a, c, t, g, unknown or other
  modified_base (751)..(752): a, c, t, g, unknown or other
  modified_base (758)..(758): a, c, t, g, unknown or other
  modified_base (762)..(762): a, c, t, g, unknown or other
  modified_base (765)..(765): a, c, t, g, unknown or other
  modified_base (768)..(768): a, c, t, g, unknown or other
  modified_base (773)..(773): a, c, t, g, unknown or other
  modified_base (779)..(779): a, c, t, g, unknown or other
  modified_base (783)..(783): a, c, t, g, unknown or other
  modified_base (785)..(786): a, c, t, g, unknown or other
  modified_base (791)..(792): a, c, t, g, unknown or other
  modified_base (795)..(795): a, c, t, g, unknown or other
  modified_base (813)..(813): a, c, t, g, unknown or other
  modified_base (828)..(828): a, c, t, g, unknown or other
  modified_base (837)..(837): a, c, t, g, unknown or other
  modified_base (843)..(843): a, c, t, g, unknown or other
  modified_base (864)..(864): a, c, t, g, unknown or other
  modified_base (868)..(870): a, c, t, g, unknown or other
  modified_base (873)..(873): a, c, t, g, unknown or other
  modified_base (876)..(877): a, c, t, g, unknown or other
  modified_base (882)..(882): a, c, t, g, unknown or other
  modified_base (888)..(888): a, c, t, g, unknown or other
  modified_base (940)..(941): a, c, t, g, unknown or other
  modified_base (963)..(963): a, c, t, g, unknown or other
  modified_base (1015)..(1015): a, c, t, g, unknown or other
  modified_base (1017)..(1018): a, c, t, g, unknown or other
  modified_base (1026)..(1026): a, c, t, g, unknown or other
  modified_base (1033)..(1033): a, c, t, g, unknown or other
  modified_base (1035)..(1036): a, c, t, g, unknown or other
  modified_base (1041)..(1041): a, c, t, g, unknown or other
  modified_base (1048)..(1048): a, c, t, g, unknown or other
  modified_base (1050)..(1050): a, c, t, g, unknown or other
  modified_base (1053)..(1053): a, c, t, g, unknown or other
  modified_base (1056)..(1056): a, c, t, g, unknown or other
  modified_base (1062)..(1062): a, c, t, g, unknown or other
  modified_base (1065)..(1065): a, c, t, g, unknown or other
  modified_base (1071)..(1072): a, c, t, g, unknown or other
  modified_base (1074)..(1074): a, c, t, g, unknown or other
  modified_base (1077)..(1077): a, c, t, g, unknown or other
  modified_base (1083)..(1083): a, c, t, g, unknown or other
  modified_base (1086)..(1086): a, c, t, g, unknown or other
  modified_base (1089)..(1089): a, c, t, g, unknown or other
  modified_base (1092)..(1092): a, c, t, g, unknown or other
  modified_base (1144)..(1149): a, c, t, g, unknown or other
  modified_base (1151)..(1159): a, c, t, g, unknown or other
  modified_base (1165)..(1165): a, c, t, g, unknown or other
  modified_base (1167)..(1167): a, c, t, g, unknown or other
  modified_base (1171)..(1171): a, c, t, g, unknown or other
  modified_base (1173)..(1177): a, c, t, g, unknown or other
  modified_base (1179)..(1179): a, c, t, g, unknown or other
  modified_base (1182)..(1185): a, c, t, g, unknown or other
  modified_base (1188)..(1188): a, c, t, g, unknown or other
  modified_base (1190)..(1190): a, c, t, g, unknown or other
  modified_base (1195)..(1199): a, c, t, g, unknown or other
  modified_base (1201)..(1201): a, c, t, g, unknown or other
  modified_base (1203)..(1205): a, c, t, g, unknown or other
  modified_base (1208)..(1208): a, c, t, g, unknown or other
  modified_base (1212)..(1213): a, c, t, g, unknown or other
  modified_base (1221)..(1221): a, c, t, g, unknown or other
  modified_base (1233)..(1233): a, c, t, g, unknown or other
  modified_base (1236)..(1238): a, c, t, g, unknown or other
  modified_base (1244)..(1244): a, c, t, g, unknown or other
  modified_base (1246)..(1248): a, c, t, g, unknown or other
  modified_base (1254)..(1254): a, c, t, g, unknown or other
  modified_base (1257)..(1257): a, c, t, g, unknown or other
  modified_base (1260)..(1262): a, c, t, g, unknown or other
  modified_base (1267)..(1267): a, c, t, g, unknown or other
  modified_base (1270)..(1271): a, c, t, g, unknown or other
  modified_base (1274)..(1275): a, c, t, g, unknown or other
  modified_base (1277)..(1278): a, c, t, g, unknown or other
  modified_base (1281)..(1289): a, c, t, g, unknown or other
  modified_base (1293)..(1293): a, c, t, g, unknown or other
  modified_base (1297)..(1300): a, c, t, g, unknown or other
  modified_base (1302)..(1302): a, c, t, g, unknown or other
  modified_base (1306)..(1308): a, c, t, g, unknown or other
  modified_base (1311)..(1312): a, c, t, g, unknown or other
  modified_base (1314)..(1314): a, c, t, g, unknown or other
  modified_base (1319)..(1320): a, c, t, g, unknown or other
  modified_base (1323)..(1324): a, c, t, g, unknown or other
  modified_base (1327)..(1329): a, c, t, g, unknown or other
  modified_base (1331)..(1338): a, c, t, g, unknown or other
  modified_base (1347)..(1355): a, c, t, g, unknown or other
  modified_base (1358)..(1358): a, c, t, g, unknown or other
  modified_base (1363)..(1365): a, c, t, g, unknown or other
  modified_base (1369)..(1371): a, c, t, g, unknown or other
  modified_base (1375)..(1377): a, c, t, g, unknown or other
  modified_base (1380)..(1383): a, c, t, g, unknown or other
  modified_base (1386)..(1386): a, c, t, g, unknown or other
  modified_base (1389)..(1389): a, c, t, g, unknown or other
  modified_base (1392)..(1392): a, c, t, g, unknown or other
  modified_base (1394)..(1395): a, c, t, g, unknown or other
  modified_base (1397)..(1398): a, c, t, g, unknown or other
  modified_base (1404)..(1407): a, c, t, g, unknown or other
  modified_base (1410)..(1418): a, c, t, g, unknown or other
  modified_base (1424)..(1424): a, c, t, g, unknown or other
  modified_base (1564)..(1647): a, c, t, g, unknown or other
  modified_base (1876)..(1876): a, c, t, g, unknown or other
  modified_base (1878)..(1878): a, c, t, g, unknown or other
  modified_base (1890)..(1890): a, c, t, g, unknown or other
  modified_base (1974)..(1974): a, c, t, g, unknown or other
  modified_base (2003)..(2003): a, c, t, g, unknown or other
  modified_base (2010)..(2010): a, c, t, g, unknown or other
  modified_base (2025)..(2025): a, c, t, g, unknown or other
  modified_base (2040)..(2040): a, c, t, g, unknown or other
  modified_base (2058)..(2058): a, c, t, g, unknown or other
  modified_base (2064)..(2064): a, c, t, g, unknown or other
  modified_base (2079)..(2079): a, c, t, g, unknown or other
  modified_base (2082)..(2082): a, c, t, g, unknown or other
  modified_base (2091)..(2091): a, c, t, g, unknown or other
  modified_base (2124)..(2124): a, c, t, g, unknown or other
  modified_base (2145)..(2145): a, c, t, g, unknown or other
  modified_base (2154)..(2154): a, c, t, g, unknown or other
  modified_base (2232)..(2232): a, c, t, g, unknown or other
  modified_base (2238)..(2238): a, c, t, g, unknown or other
  modified_base (2305)..(2307): a, c, t, g, unknown or other
  modified_base (2503)..(2718): a, c, t, g, unknown or other
  modified_base (2727)..(2727): a, c, t, g, unknown or other
  modified_base (2729)..(2730): a, c, t, g, unknown or other
  modified_base (2732)..(2732): a, c, t, g, unknown or other
  modified_base (2736)..(2736): a, c, t, g, unknown or other
  modified_base (2738)..(2742): a, c, t, g, unknown or other
  modified_base (2746)..(2748): a, c, t, g, unknown or other
  modified_base (2750)..(2750): a, c, t, g, unknown or other
  modified_base (2752)..(2757): a, c, t, g, unknown or other
  modified_base (2759)..(2761): a, c, t, g, unknown or other
  modified_base (2763)..(2765): a, c, t, g, unknown or other
  modified_base (2767)..(2767): a, c, t, g, unknown or other
  modified_base (2770)..(2772): a, c, t, g, unknown or other
  modified_base (2774)..(2775): a, c, t, g, unknown or other
  modified_base (2777)..(2781): a, c, t, g, unknown or other
  modified_base (2784)..(2784): a, c, t, g, unknown or other
  modified_base (2786)..(2787): a, c, t, g, unknown or other
  modified_base (2794)..(2794): a, c, t, g, unknown or other
  modified_base (2799)..(2799): a, c, t, g, unknown or other
  modified_base (2802)..(2802): a, c, t, g, unknown or other
  modified_base (2805)..(2806): a, c, t, g, unknown or other
  modified_base (2808)..(2808): a, c, t, g, unknown or other
  modified_base (2812)..(2813): a, c, t, g, unknown or other
  modified_base (2815)..(2815): a, c, t, g, unknown or other
  modified_base (2817)..(2826): a, c, t, g, unknown or other
  modified_base (2831)..(2833): a, c, t, g, unknown or other
  modified_base (2837)..(2841): a, c, t, g, unknown or other
  modified_base (2844)..(2844): a, c, t, g, unknown or other
  modified_base (2852)..(2853): a, c, t, g, unknown or other
  modified_base (2865)..(2865): a, c, t, g, unknown or other
  modified_base (2868)..(2870): a, c, t, g, unknown or other
  modified_base (2877)..(2877): a, c, t, g, unknown or other
  modified_base (2880)..(2880): a, c, t, g, unknown or other
  modified_base (2889)..(2889): a, c, t, g, unknown or other
  modified_base (2893)..(2893): a, c, t, g, unknown or other
  modified_base (2899)..(2899): a, c, t, g, unknown or other
  modified_base (2901)..(2901): a, c, t, g, unknown or other
  modified_base (2906)..(2906): a, c, t, g, unknown or other
  modified_base (2910)..(2910): a, c, t, g, unknown or other
  modified_base (2916)..(2916): a, c, t, g, unknown or other
  modified_base (2918)..(2919): a, c, t, g, unknown or other
  modified_base (2925)..(2925): a, c, t, g, unknown or other
  modified_base (2929)..(2930): a, c, t, g, unknown or other
  modified_base (2934)..(2934): a, c, t, g, unknown or other
  modified_base (2939)..(2940): a, c, t, g, unknown or other
  modified_base (2943)..(2944): a, c, t, g, unknown or other
  modified_base (2951)..(2952): a, c, t, g, unknown or other
  modified_base (2955)..(2956): a, c, t, g, unknown or other
  modified_base (2958)..(2966): a, c, t, g, unknown or other
  modified_base (2968)..(2968): a, c, t, g, unknown or other
  modified_base (2975)..(2979): a, c, t, g, unknown or other
  modified_base (2981)..(2983): a, c, t, g, unknown or other
  modified_base (2988)..(2988): a, c, t, g, unknown or other
  modified_base (2994)..(2996): a, c, t, g, unknown or other
  modified_base (3001)..(3008): a, c, t, g, unknown or other
  modified_base (3014)..(3015): a, c, t, g, unknown or other
  modified_base (3018)..(3018): a, c, t, g, unknown or other
  modified_base (3020)..(3020): a, c, t, g, unknown or other
  modified_base (3023)..(3024): a, c, t, g, unknown or other
  modified_base (3030)..(3030): a, c, t, g, unknown or other
  modified_base (3032)..(3032): a, c, t, g, unknown or other
  modified_base (3036)..(3041): a, c, t, g, unknown or other
  modified_base (3043)..(3048): a, c, t, g, unknown or other
  modified_base (3051)..(3051): a, c, t, g, unknown or other
  modified_base (3055)..(4608): a, c, t, g, unknown or other
nnngcccagactcggcccgaaccacgcgtgccaatatttgatccgcaccattttcagccgagcagaagttcatgttacgacgagaatggacggnnncctcagcggtgtgtgcccgacttcatcaatgtggcattcactttggaantnnangtcagcaacacctgtggagtgcgtcagcccacccgtttctgtgtgcaaacnggccacatgggcaccaataaagtttgtganatttgcgatgcgcgagtgccggcatacgcgcanccggccatttacctcactnnttnnaanantnnnnanaacgaaacatggtggcaatcggaaacaatggtaaattcaaatacngcttcgannnnngtnaatttgannnnnnnnnnnnnnnaannnnttnnnntngcatatgtacgcctnaaatttgtcagcccaaggcctgagagttttgtgatttacaagaaaaccgagcatggcggtgaatggattccntggcaatattacngtggntcntgncgcnnnacattcaaattgcccgaaaaagcgccaattttgccnggcaangaggcagttgcgcagtgtacgcgtgaattctcggacatttcacccctgactggcgggaacattgcnttttccacgctgganggacgtccatcngcngagatttttgangagagtgaagtgctncagnantgggtgacngccgaagaaatccgaatcagcctggtccgnatgaacacnttnggagatgaaattttcnncgacanccgngtnctncgcanctattnctangnnatcanngantttgcggttggcggtcgntgcaaatgcaacggncatgccaancagtgngtcaactcgacgggctatcangggnnncancanntggtntgcgantgccagcacaacacggtgggggtggactgccaggagtgcgcgcctctctacnnggataggccatggcgtcccgcnacttccacggaggccaatgagtgcttgccgtgccaatgcaatggcctggccnannggtgcttnttcgatncnnaactntttgagnanacnggncatggnggncattgnntngantgtgcnggnaanacncagggcccccattgtgaattctgcatggccaaccattggcgtgccaaaggtnnnnnntnnnnnnnnncctgcnantgcnannnnntnggnnnngtngngagcnnnnncnannncancggnnaatgccantgcaaaccgggngtnnntggccnannntgtgancantgnnngcccngtnnctnngnnttnnnnnnnnncggntgcnnnnantgcnnntgnnanccggnnggnncgnnnannnnnnnnccaaactgnnnnnnnnncantgggnnntgtnnntgcnnngannnngtnganggncnncnntgtgannnntgnnnnnnnnnccattnccaattgtcgtccaagaatttgttcggctgtacaccttgcttctgctttggtcattcatcaatttgctctccggccgatggattctatgccgtcaatgtcagctccacattcgatgaagatactgaagaatggagtggtnnnnnnnnnnnnnnnnnnnnnnnnnnnnnnnnnnnnnnnnnnnnnnnnnnnnnnnnnnnnnnnnnnnnnnnnnnnnnnnnnnnnttttatattgcccctccaaagttcctgggcgaccaacgccttgcctatggccaattccttcgcttcgccatgcgcaagtcgtttccctatgcgtggcagtccaaccgggacattcaactggttggcgccaacgggcgggtgctttcactgccgttgggtgcgcaaggcaatgccgggccctcggacaaattgcagcattatcagttcagaatccattcggatccaaagntncagtggaatccncatctgcgtgaaatcgacttcatcggcgttctctccaatttgaccgaaatccgcttgcgtgccacttttaacgccgacgacatnggctacttgtcgcacttctcgttgggcantgccggncttcaccccgaggcnggcattccccgacgngccgactgggtggagcantgccantgcccggcacaatanggnggacagttntgccagcattgcgcattggcacacaaacgggcncagccttttggggggcccttnatgaagtgngtgccgtgccaatgcaacggccatgccgttgagtgtgaagcggagtcgggcgcttgcaaatgcgcgcacaacactgcnggcganacgtgtgaacgctgcgcccgtggcttctatggtgacgcacttcaaggcactgtcaacgattgcaaannntgcggctgccccgaaggtgggccttgtgttcagctggaagatgggcttgtgatgtgcacggaatgtccagaaggttatgccggcccgcggtgcgagtattgcgcagaggagcactttggcaatccccaagctggacagccttgccgacggtgcaattgcaatgaaaatgttgatatgaatgccattggacaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtcggncnncnctgngnnnnntgcnnncncnnnnnntnnnannncnccnnngnncnnnnntgncnncactgcnattgnganccnntnggcnntntnnnnnnnnnntgcgnnnagcnnnnnggncaatgccnntgcaaaccgggngtnnntggcccncantgtgaccantgcntgcccngncactntggnttcggncnncacggntgcnnccantgcanntgnnatccggnnggnncnnnnnnnnngnaatgcgnnnnncnnnatggncaatgnnngtgcnnnnnnnntgttgnnggncngcnntgtgancngtgnnnnnngnnnnnntangggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 163 - DNA, 1365 bp, Artificial Sequence
  Description of Artificial Sequence: Synthetic polynucleotide
  modified_base (1)..(312): a, c, t, g, unknown or other
  modified_base (323)..(323): a, c, t, g, unknown or other
  modified_base (327)..(327): a, c, t, g, unknown or other
  modified_base (330)..(330): a, c, t, g, unknown or other
  modified_base (332)..(333): a, c, t, g, unknown or other
  modified_base (336)..(336): a, c, t, g, unknown or other
  modified_base (386)..(386): a, c, t, g, unknown or other
  modified_base (388)..(388): a, c, t, g, unknown or other
  modified_base (393)..(393): a, c, t, g, unknown or other
  modified_base (400)..(400): a, c, t, g, unknown or other
  modified_base (402)..(402): a, c, t, g, unknown or other
  modified_base (409)..(409): a, c, t, g, unknown or other
  modified_base (411)..(411): a, c, t, g, unknown or other
  modified_base (414)..(415): a, c, t, g, unknown or other
  modified_base (417)..(417): a, c, t, g, unknown or other
  modified_base (420)..(420): a, c, t, g, unknown or other
  modified_base (422)..(423): a, c, t, g, unknown or other
  modified_base (426)..(426): a, c, t, g, unknown or other
  modified_base (432)..(432): a, c, t, g, unknown or other
  modified_base (500)..(500): a, c, t, g, unknown or other
  modified_base (505)..(505): a, c, t, g, unknown or other
  modified_base (761)..(761): a, c, t, g, unknown or other
  modified_base (776)..(776): a, c, t, g, unknown or other
  modified_base (822)..(822): a, c, t, g, unknown or other
  modified_base (840)..(841): a, c, t, g, unknown or other
  modified_base (843)..(843): a, c, t, g, unknown or other
  modified_base (897)..(897): a, c, t, g, unknown or other
  modified_base (993)..(993): a, c, t, g, unknown or other
  modified_base (1006)..(1007): a, c, t, g, unknown or other
  modified_base (1062)..(1062): a, c, t, g, unknown or other
  modified_base (1258)..(1258): a, c, t, g, unknown or other
  modified_base (1260)..(1260): a, c, t, g, unknown or other
  modified_base (1269)..(1269): a, c, t, g, unknown or other
  modified_base (1271)..(1272): a, c, t, g, unknown or other
  modified_base (1329)..(1329): a, c, t, g, unknown or other
  modified_base (1337)..(1339): a, c, t, g, unknown or other
  modified_base (1341)..(1341): a, c, t, g, unknown or other
  modified_base (1348)..(1365): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtcatcanaaangcngnnctnatcgagtactacgacgtgtccggctgctatgtgcttcgtccctggtcctncnccatntgggagncnatccaancnttnntngangnnganatcaanaagttgggcgtcaagaactgctacttcccaatgttcgtcacggagggggcgctgaggaatgaggaganccatntggccgggtttgcgtccgaggtcgcctgggtgactcgggccggcgcctcgaagctggccaagccaattgccatccgcccgaccagcgagaccgtgatgtacccgagttttgcgagatggtgccaatcccatcgggacttgcccatcaagctgaaccagtggtgcaatgtggtgcgctgggaattcaaacacccaatgccatttctgcgcagccgggagttcctctggcaagaaggtcacaccgcctacgccacagnggaggaggcggtggncgaagtgttcaccatttgcgacctctatgcccgggtctacaccganttgctggcaatcccggtnntnaagggccgaaagtcggagaaggagaaattcgcgggcggcgactttaccaccacngtggaggcctacgtgcccgcgaatggacgggcaattcagggcgccacttcccaccatttgggccagaacttctccaaaatgttctccatttgcttngagcatcccgacnngccgggccaaaaggagttcgcatggcaaaacagttggggcatttccacgcgcacnatcggcgcaatggtcatggtccatggggacgacaaggggttggtgctgcccccgagagtggctgccattcaggtggttgtgattccggtgggcataaaaacagaggaccgccaaaagctgatgggaaaagccgaggagattgtgaagcagttgggcgagaaaggcattcgagtggagggagatcttcgggagaatnantcgcccggntnnaagttcaaccattgggagctcaaaggcgtgccgatccgactggagttgggcccaaangacttggnnnangaacaannnnnnnnnnnnnnnnnn

SEQ ID NO: 164 - DNA, 570 bp, Artificial Sequence
  Description of Artificial Sequence: Synthetic polynucleotide
  modified_base (1)..(42): a, c, t, g, unknown or other
  modified_base (405)..(405): a, c, t, g, unknown or other
  modified_base (538)..(570): a, c, t, g, unknown or other
nnnnnnnnnnnnnnnnnnnnnnnnnnnnnnnnnnnnnnnnnnccgcgtcgtccattcgagaaggagcgacttgactcggagctcaaactgatcggcgagttcggactgcgcaacaagcgtgaagtgtggcgcgtcaagctgacactggccaaaatccgcaaagccgctcgtgaactgctcaccctggaggacaaggacccgaagcgattgttcgagggcaacgccctgctgcgtcgtttggtccgcattggcgtgctgtccgaggacaagatgaagctggattacgtgctgggcttgcgcgtggaggacttccttgagcgtcgcctgcaaacccaggttttcaagctgggattggccaaatccatccatcatgcgcgtgtgctgatccgccaaaagcacatctgngtgcgcagacaagtcgtgaacatcccatccttcattgtgcgcctggactcccaaaagcacatcgacttctccagcaagtctccgtacgccggcggtcggcccggacgtgtcaagcgaaagaacgcgaagaagnnnnnnnnnnnnnnnnnnnnnnnnnnnnnnnnn

SEQ ID NO: 165 - DNA, 1311 bp, Artificial Sequence
  Description of Artificial Sequence: Synthetic polynucleotide
  modified_base (1)..(183): a, c, t, g, unknown or other
  modified_base (208)..(210): a, c, t, g, unknown or other
  modified_base (213)..(213): a, c, t, g, unknown or other
  modified_base (215)..(215): a, c, t, g, unknown or other
  modified_base (246)..(246): a, c, t, g, unknown or other
  modified_base (270)..(270): a, c, t, g, unknown or other
  modified_base (325)..(325): a, c, t, g, unknown or other
  modified_base (327)..(327): a, c, t, g, unknown or other
  modified_base (331)..(331): a, c, t, g, unknown or other
  modified_base (367)..(372): a, c, t, g, unknown or other
  modified_base (516)..(516): a, c, t, g, unknown or other
  modified_base (603)..(603): a, c, t, g, unknown or other
  modified_base (652)..(657): a, c, t, g, unknown or other
  modified_base (807)..(807): a, c, t, g, unknown or other
  modified_base (979)..(1311): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactccaccatgacgcggttgcacnnnaantnccggatcattgtggttgaggggaacattggnagtggaaagagtgaatttgcggcncaactggcccaagagcttggcttctaccacatgcccgccttttccatgaacgaantnctgntcgatcggtacgggaatgatttgcgcaaattctatnnnnnntttccaaagcgctatcgaacacctgacgagctgatgttctatgccaacccaacggacgacaacaccgccgtcatgcaggacaccatctaccagtgtcgctttgaccagcacatgaacgcgctggcgcacatttttaacacagcncaaggcgtggtgatggagcgctccgtgttcagcgactttgtgtttgtgaacgcaatgcgcgagaagggatggatcagtccggaatcnttcaaatactaccattttgcacggaaagtgaccctgcccaagctgcatnnnnnnccacatctgtacatctacctgaacgcgcccatctcgaagtgcttggagaacatcaaaaagcggggaaatgccaatgaaattgagcacgttgatgccagatacctgaaaaccatcgaggagtcctacaaggactttctgcgcgaagtgaanctcgggtcctatgtgctctcctacgactgggcccagcccgagtacatggacatcgtgttggaggacatcttcaacctgaacatggacacctacgagtggcacaccagtgatgtgttgcagccgtggcacagcattggcgaggccgacttcaactatgggtggcacagatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 166 - DNA, 1356 bp, Artificial Sequence
  Description of Artificial Sequence: Synthetic polynucleotide
  modified_base (1)..(1134): a, c, t, g, unknown or other
  modified_base (1354)..(1356): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctacatagatcaagaaagcaaagcgccattgctgcgattcagtcccaaagtcagcgactgcgcccctctgttcagcattggcacttggatggggctgattgttgcgctgctgctcattggggtgctctccttcggcttcctcatgctcaactccgtccagacgatggaccgcttcgatgaccccaagcagaaacaattggttatcaacgccaaggaannn

SEQ ID NO: 167 - DNA, 474 bp, Artificial Sequence
  Description of Artificial Sequence: Synthetic polynucleotide
  modified_base (183)..(183): a, c, t, g, unknown or other
  modified_base (472)..(474): a, c, t, g, unknown or other
atgattcattacatgttgcttttctccagacaaggaaaattgcgcttgcaaaaatggtatatggcctatccagacaaggcaaagaagaaaatcacgcgtgagctgatcaccacaatattggggagaaaaccaaaaatgtgcgcctttctggaatataaagagttgaaagttgtgtataaaagntatgcttcactctacttttgctgtgcaattgaacagtcggacaatgagttgctttgtctggaaattattcatcgatatgttgaattgttggaccgatattttggcagtgtttgcgaattagacatcatcttcaattttgagaaggcctatttcattttggacgagtttcttctggctggcgaaatacaagaaacgagcaaaaagcaagtattgaaggccatcagcgcacaggaccttattatggatgaggaaaccacccagggctttttcgaagacaatggtctcggtnnn

SEQ ID NO: 168 - DNA, 624 bp, Artificial Sequence
  Description of Artificial Sequence: Synthetic polynucleotide
  modified_base (1)..(9): a, c, t, g, unknown or other
  modified_base (19)..(19): a, c, t, g, unknown or other
  modified_base (24)..(24): a, c, t, g, unknown or other
  modified_base (27)..(27): a, c, t, g, unknown or other
  modified_base (37)..(39): a, c, t, g, unknown or other
  modified_base (84)..(84): a, c, t, g, unknown or other
  modified_base (108)..(108): a, c, t, g, unknown or other
  modified_base (168)..(168): a, c, t, g, unknown or other
  modified_base (180)..(180): a, c, t, g, unknown or other
  modified_base (208)..(309): a, c, t, g, unknown or other
  modified_base (330)..(337): a, c, t, g, unknown or other
  modified_base (477)..(480): a, c, t, g, unknown or other
  modified_base (603)..(603): a, c, t, g, unknown or other
  modified_base (609)..(609): a, c, t, g, unknown or other
  modified_base (618)..(618): a, c, t, g, unknown or other
  modified_base (622)..(624): a, c, t, g, unknown or other
nnnnnnnnnttgttcaaangagcnttntcactatcannngcccttcaacaagaacaagtcatcagacctcctgtacaagtctcnggagtggaaggcaaatacgcttcngctctttattcatcaggagtgaaggagaaaagtctcgacaaattggagaaggatcttcancaagtcaaggcnttgtatgacactaacaaggactttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgttttggccgaagggggnnnnnnnnacaaactgcccgggattgtctcctcattcgagaccattatgcgtgctcatcgaaatgaactccaggttgaagttaccagcgcagagccactcaataagaaacaagaacaggcactgaacgatgctctacagaaattcgcnnnnactggaaagaagctgaacatttcattcaccgtcaaaccatcaatgatcggcggtcttgtggtcactgttggcgacaaatacattgacatgtcggtggcatccaagctgaagaaaattgacacnctgatngaaaaggcnattnnn

SEQ ID NO: 169 - DNA, 1746 bp, Artificial Sequence
  Description of Artificial Sequence: Synthetic polynucleotide
  modified_base (39)..(39): a, c, t, g, unknown or other
  modified_base (42)..(42): a, c, t, g, unknown or other
  modified_base (46)..(47): a, c, t, g, unknown or other
  modified_base (49)..(49): a, c, t, g, unknown or other
  modified_base (52)..(56): a, c, t, g, unknown or other
  modified_base (135)..(135): a, c, t, g, unknown or other
  modified_base (222)..(222): a, c, t, g, unknown or other
  modified_base (240)..(240): a, c, t, g, unknown or other
  modified_base (258)..(258): a, c, t, g, unknown or other
  modified_base (264)..(264): a, c, t, g, unknown or other
  modified_base (390)..(390): a, c, t, g, unknown or other
  modified_base (411)..(411): a, c, t, g, unknown or other
  modified_base (426)..(426): a, c, t, g, unknown or other
  modified_base (525)..(525): a, c, t, g, unknown or other
  modified_base (612)..(612): a, c, t, g, unknown or other
  modified_base (618)..(618): a, c, t, g, unknown or other
  modified_base (628)..(628): a, c, t, g, unknown or other
  modified_base (633)..(633): a, c, t, g, unknown or other
  modified_base (654)..(654): a, c, t, g, unknown or other
  modified_base (669)..(669): a, c, t, g, unknown or other
  modified_base (735)..(735): a, c, t, g, unknown or other
  modified_base (759)..(759): a, c, t, g, unknown or other
  modified_base (780)..(780): a, c, t, g, unknown or other
  modified_base (796)..(796): a, c, t, g, unknown or other
  modified_base (813)..(813): a, c, t, g, unknown or other
  modified_base (831)..(831): a, c, t, g, unknown or other
  modified_base (843)..(843): a, c, t, g, unknown or other
  modified_base (845)..(845): a, c, t, g, unknown or other
  modified_base (850)..(850): a, c, t, g, unknown or other
  modified_base (880)..(888): a, c, t, g, unknown or other
  modified_base (931)..(933): a, c, t, g, unknown or other
  modified_base (1039)..(1039): a, c, t, g, unknown or other
  modified_base (1216)..(1216): a, c, t, g, unknown or other
  modified_base (1239)..(1239): a, c, t, g, unknown or other
  modified_base (1249)..(1249): a, c, t, g, unknown or other
  modified_base (1251)..(1251): a, c, t, g, unknown or other
  modified_base (1269)..(1269): a, c, t, g, unknown or other
  modified_base (1272)..(1272): a, c, t, g, unknown or other
  modified_base (1314)..(1314): a, c, t, g, unknown or other
  modified_base (1428)..(1428): a, c, t, g, unknown or other
  modified_base (1491)..(1491): a, c, t, g, unknown or other
  modified_base (1494)..(1494): a, c, t, g, unknown or other
  modified_base (1497)..(1497): a, c, t, g, unknown or other
  modified_base (1560)..(1560): a, c, t, g, unknown or other
  modified_base (1629)..(1629): a, c, t, g, unknown or other
  modified_base (1632)..(1632): a, c, t, g, unknown or other
  modified_base (1663)..(1663): a, c, t, g, unknown or other
  modified_base (1678)..(1680): a, c, t, g, unknown or other
  modified_base (1720)..(1746): a, c, t, g, unknown or other
atggcgatgtcaattccaaaatctgggtacgcgcggttnatnaaannangannnnngcacttcaaaggcatggatgaggccgtcaagcgtaacattgaagcttgcatggaattgagttctcaaacgcgttcggcntatggaccaaatggaatgaacaagatggtcattaaccgcttggaaaagctcttcgtcacgaatgacgctgtttctattctgaatganttggaggtgcagcatccngctgctcgaattcttgtncttgcngcccaaatgcaagaaaagcaaatcggcgacaacacaaacaccgttgtgatttttgccgcctcattgttggaacaatcattacaattgctggacatgggcataactgctgtggaagttgcttctggntatgaacaagcgctggtcaangccgaggagatcttncccaaattggtgattgcaaaagccgaagacttgcacaatctggacaaagtgaaggcctatctgaagtcatcgattatttccaagcaagcggatcattangagatgatcgcagatcttgttgcaaaggcttgcgttcaaattgtgcccaagaacagcaacaatttcaatgtggacaacattcgagtntgcaanattttgggcnctggngttgcaagttcgcacatcacnaatgggatggttttnaaacgtggcgccgaaggtgaggtgaaacaagttcaaaatgcgcgagtcgccatcttcgcttgtccntttgacttgaaccagactgaaacnaagggaacaattctgatgaanacggccgatgatttantgaagttcagcagcacngaagaatcacaggtggangagcaagtcaancnattgncggaggcgggtgtcaatgttgtggtggcgnnnnnnnnnttactgaagttcagcagcactgaagaatcacaggtggaagagnnncaagtcaaacaattggcggaggcgggtgtcaatgttgtggtggcggctggcaaatttggcgatctttacctccatttcctgaacaagtacaaaatcatgggtgtcngattgacttccaaatttgatttgcgccgtctttgccttactttgggtgcccaagctcaagcacgaatttgcgctccccaaatccatgcacttgggcaatgcgatgatgtgttcatcaaagaaattggagaaacacaggtcgtcatattcgacaagaaaagcgagagtgggaaagtgncgaccataatcgtgcgtggctcntcccaatcantncttgatgacgttgaacgngcnattgatgatgccgtgaacacttacaaagctttgaccaagganaatcgacttttggccggtgcaggtgcaaccgagattgaattagcccggcaaattggggaatttggcgaaaaacagtcgggactccaacaatatgcaatcaaaaaattcgccacngccttggaagttctgccaaagcaattagccgagaatgcaggattgaaaccaaccgagactctntcnganttgtatgctgcgcacgaaaagggatcggccacccaaggaatcgatgtgcttgctgccaaactnattgatgcaaaggaggcgggaatttttgatttgttcaacagcaaattgcttgccatcaagctggccacnaangctgcctgttccattctcaaaattgaccagnttatcatggctaaannncccgttggcgggccaactccgcgtggaccaaaggcccaannnnnnnnnnnnnnnnnnnnnnnnnnn

SEQ ID NO: 170 - DNA, 1770 bp, Artificial Sequence
  Description of Artificial Sequence: Synthetic polynucleotide
  modified_base (1)..(132): a, c, t, g, unknown or other
  modified_base (367)..(378): a, c, t, g, unknown or other
  modified_base (507)..(507): a, c, t, g, unknown or other
  modified_base (958)..(1320): a, c, t, g, unknown or other
  modified_base (1548)..(1548): a, c, t, g, unknown or other
  modified_base (1551)..(1552): a, c, t, g, unknown or other
  modified_base (1554)..(1555): a, c, t, g, unknown or other
  modified_base (1557)..(1557): a, c, t, g, unknown or other
  modified_base (1559)..(1564): a, c, t, g, unknown or other
  modified_base (1566)..(1574): a, c, t, g, unknown or other
  modified_base (1576)..(1576): a, c, t, g, unknown or other
  modified_base (1578)..(1579): a, c, t, g, unknown or other
  modified_base (1582)..(1582): a, c, t, g, unknown or other
  modified_base (1584)..(1585): a, c, t, g, unknown or other
  modified_base (1587)..(1592): a, c, t, g, unknown or other
  modified_base (1594)..(1596): a, c, t, g, unknown or other
  modified_base (1663)..(1665): a, c, t, g, unknown or other
  modified_base (1768)..(1770): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgaatcctgaagatggttacggaaatgggctcagcagccgtgggtggcatcagcccagcgttgagtgcaagtgccgcaaaatcctttttggaagcaacggacaaggagaagaaggagatgcaaaacctcaatgaccgtctggccaactacattgaccgtgtcaagagtttggaggagcagaaccggaagttggtgggcgatttggaggatttgcgcggacaatggggcaaannnnnnnnnnnntttcagataaaatactcgaccacactttccactgcacgcaaagacattgaccaagcggcacgtgacaaggcagcattggacgtgaaagttgctcgtcttcgggatgatttgaatgaataccgtaactgnttcgaagacatcaaccgacgtcgcgaatcggaccgcgagcacattgcccagttcacgaacatgattgcggatgcccaaagcgagttggaaatgcttcgagcccgctggaagcaactgactgacgaggagaaacgcttgattggggacaattctcgcctatgggatgaactgaccaaagcgcgcaatgatttggatgaagagacacttggccgcattgacttccagaatcaagtgcaaacgttgatggaggaattggagttccttcgccgtgtgcatgagcaagaggtgaaagagctgcaagcattgcttgcccaagcacctgcagacacacgtgaattcttcaagaatgagctggcattggccatccgtgacatcaaggacgagtatgactacattgccaaacaagggcgtcaggacatggagagctggtacaagcttaaggtgcgtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggttgtcaaaacccactccctgcaacaacaagaagagaccgactccacgcggaatgtgcgtggcgaagtccaaaccaagacaacattccagcgctcggccaaaggcaacatcaccattgcggagtgcgagcccacagggaagtacatcacgctggagaacacgcatcgttccaaggacgaggacatttcgggctgccgcctgaagcgcaaactggacggaaagcgnganntnnantnnnnnntnnnnnnnnntntnnttntnnannnnnnannntttttaaagatttggtcagcgggccaaggcggtgtgcacagccccccggaatccctggtggcccccnnngaggagacctggggcgtcggccagaacgtggtgaccgccttctacaacaaggagggcgaggagcgagccactcacacccagaagaccgtccaaactgggcaannn

SEQ ID NO: 171 - DNA, 2907 bp, Artificial Sequence
  Description of Artificial Sequence: Synthetic polynucleotide
  modified_base (1)..(12): a, c, t, g, unknown or other
  modified_base (459)..(459): a, c, t, g, unknown or other
  modified_base (672)..(672): a, c, t, g, unknown or other
  modified_base (963)..(963): a, c, t, g, unknown or other
  modified_base (1101)..(1101): a, c, t, g, unknown or other
  modified_base (1110)..(1110): a, c, t, g, unknown or other
  modified_base (1131)..(1131): a, c, t, g, unknown or other
  modified_base (1140)..(1140): a, c, t, g, unknown or other
  modified_base (1147)..(1147): a, c, t, g, unknown or other
  modified_base (1161)..(1161): a, c, t, g, unknown or other
  modified_base (1204)..(1206): a, c, t, g, unknown or other
  modified_base (1227)..(1227): a, c, t, g, unknown or other
  modified_base (1263)..(1263): a, c, t, g, unknown or other
  modified_base (1281)..(1281): a, c, t, g, unknown or other
  modified_base (1298)..(1298): a, c, t, g, unknown or other
  modified_base (1302)..(1302): a, c, t, g, unknown or other
  modified_base (1506)..(1506): a, c, t, g, unknown or other
  modified_base (1675)..(1791): a, c, t, g, unknown or other
  modified_base (1815)..(1815): a, c, t, g, unknown or other
  modified_base (1839)..(1839): a, c, t, g, unknown or other
  modified_base (1854)..(1854): a, c, t, g, unknown or other
  modified_base (1933)..(1933): a, c, t, g, unknown or other
  modified_base (1941)..(1941): a, c, t, g, unknown or other
  modified_base (1956)..(1956): a, c, t, g, unknown or other
  modified_base (1962)..(1962): a, c, t, g, unknown or other
  modified_base (2069)..(2070): a, c, t, g, unknown or other
  modified_base (2072)..(2073): a, c, t, g, unknown or other
  modified_base (2180)..(2182): a, c, t, g, unknown or other
  modified_base (2184)..(2185): a, c, t, g, unknown or other
  modified_base (2187)..(2187): a, c, t, g, unknown or other
  modified_base (2189)..(2190): a, c, t, g, unknown or other
  modified_base (2491)..(2907): a, c, t, g, unknown or other
nnnnnnnnnnnnacagcggacgaagttcggcaagctttcattgactttttcaagaaggaaaaggagcacacttactatcattcttcttcagttattccgcatgatgacccaactttgttgttcgccaatgccggcatgaaccaattcaaacccatcttccaagaaactgtggaccccaacagcgatttgggccgtttgaaacgagcagtgaacactcaaaagtgtattcgcgccggtggcaagcacaacgatttggacgatgtcggcaaggatgtctaccatcacaccttctttgagatgttgggaaactggtcgtttggcgactattttaagaatgaaatttgcacttgggcctgggaattcctcactcaatggctgcaaattccagccgatcgtctctatgtctcatattttggcggtgatgcggaagccggacttgatccggacgaggattgctgncaaatttggctcacccttggcgttcccgagtcccatttgctgccatttggcatgaaggacaacttctgggagatgggcgacactggcccctgtggtccttgctctgaaatccactatgatcgcattgggggtcgggatgcgtccaaactggtcaatgccgatgacccaatggtggtggagatttggaatcttgtgttcattcaatttaacagngaggagggcggtcaactcaaatctctgcccaacaagcacatcgattgtggccttggcttggaacgtcttgtggccgttgtccaacagaaaacatccaactacgacactgacctgttcacccccattttccgacaaatccatgaggagacaggagtgcgcgaatacaccggcaatgtgggccccaaagatgtggatggagtggacatggcctatcgggtggtcgcagaccacatccgaacattgactgtggcgcttagcgacggtggggtgccggattgcacgggaagaagntatgtacttcgtcgaatccttcgaagaggcgttcgatatgccaccgagaaattgaacgcaaaacccggcttttttgcttcattagttcccgttgttatcgacattttgggcaacacattccctgaattgcggaaaganccaacttcngtcattgacataatcaacgangaagaggcncaatttntgaaaaccctccgncgcggccatgttctcttcgagaaggccgtaaaagcattgccannnggcaccaagacattgccagtncaaattgcatggcgtctctacgacacctacggcttncccgtggacttgacccanttgatggcggaagagangggncttgctgtacagatggacgagtacgaggaatgtcgcaaaaaggccattgaaatttcctcttccggcgctgccaaaatgcaagatgccctcaacttggacgtgcacacactggccgagctgcaaaagggaggcgttccaacaaccgatgactcgcccaaatatgtgtacggatacgatgggaagggatggcaagcggcatacatntttgaaaaatgcactggcaaaatccaacgcatccgagttggcaccgaatttgtggacaccattgaatcgggccaagaaggcgcactcctgctggatcggacctgcttttacgccgaacaaggtggccagatctacgacaccggcgtgctcaccaaaattggcgatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgttggctgatcatgaagaancacaccggaacgcatgtgctcaantacgcgctccaaaangtgctgaccacggtggaccagaagggctcgctggttgcgcccgaccgaatgcgctttgacttcacctccaaacaagcantgggcgtngagcaggtcaagcgngtggangaggcgggccagcagttgatcgacacccaggagaccgtctactcacaggagtgcgctcttgcaaaggcgaaggaaatcaaggggttgcgtgccgttttcgatgaggnntnncctgacccagtccgagttgttgccgtcggtgtgccggttgacaatcttctggaagatccgaacagcccactaggcttgaacacatccgtggaattttgtggaggaannnanntncnnaatgtttcgcacattggcaagctggtgatcaccaccgaggaggccattgccaagggcattcgccgaattgttgccgtcactgggcccgaggcggaaaaggcaatccacgctgcggaccgattggacagacggatggaagaattgttggaggaggcgaaaaaggaccaggaattggcggccagcacgggcgatgaggaggcaatcaagcagattggcaggaaaatcaccgaagaactcggcaccgcgcaattgccctattggcggagggacgcgctgcgcgagaaagtcaagcagctgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 172 - DNA, 1443 bp, Artificial Sequence
  Description of Artificial Sequence: Synthetic polynucleotide
  modified_base (1)..(156): a, c, t, g, unknown or other
  modified_base (553)..(624): a, c, t, g, unknown or other
  modified_base (783)..(783): a, c, t, g, unknown or other
  modified_base (940)..(1443): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagatcaaaccgagcagttatggccagcggcgcaattattccagcattgatatatccgccgaaaaatggttgatggcttatgatgagagctcacttgcaaaattggcgaatcccccatcattggctgatgggattggcagtgatttggaaaaggaagtccgctatctgggatgcgagctcatccaatccggtgccattttgttgaaattgagtcaaactgctgcggctactggccaaatattgtttcaacgattctattatcagaaatcctttgtgcgatacaattttgagcacatggtaatggcttgcctgcttctggccggcaaaattgaagaggagcccagaaagccacgtgatgttctgaacgtttaccatcggctcaaacaactttatcagnnnnnnnnnnnnnnnnnnnnnnnnnnnnnnnnnnnnnnnnnnnnnnnnnnnnnnnnnnnnnnnnnnnnnnnntacttgcacaccaagaatgccgtcatcaaagcggagcggcgtcttctcaacacactcggctttgttgtgcacgtccatcatccgcacaaactcatctacatttacctccacatccttgggctgctccaccgggaaaatgatccaaatgtaaccgaaganagctacatgaacgatggtcttcgcacggacatgttcctgcgctacacacccgagacaattgcatgcgcctgcattcagcttgccgtcaaaaccgtcaatcggcccattgtattgcccaaggatccatttccatggttaattattttaaaaacaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 173 - DNA, 1059 bp, Artificial Sequence
  Description of Artificial Sequence: Synthetic polynucleotide
  modified_base (1)..(375): a, c, t, g, unknown or other
  modified_base (483)..(483): a, c, t, g, unknown or other
  modified_base (985)..(1059): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtcttcattgtcaagggcaaggaggacgcgctggtcaccaaaaacctagtgcccggcgaatccgtctacggcgagaagcgcatttccgtgcaggacggcaccgtnggcacggagtaccgcgtgtggaacccgttccgctccaagctggccgcctcaatcatggccggcatcgaggactcgcacatcttcccgggcgcgcgtgtgctctacctgggtgcggcgtcgggcacctccgtttcccatgtgtcggacattgtgggaccggaaggcattgtctacgccgttgagttctcccatcgcagcgggcgtgacctgttgggcatggccaagaagcgaccgaatgtggtgcccattgttgatgacgcacggcacccgcacaaatatgcgatgatggtgggcattgtggacacaatcttctcggacgtggcccaacccgaccaggcgcgcattgtggcccacaacgcgcacaaattcctgaagaacaacggccacgcggtcatctccatcaaggccaactgcattgacagcacggccgagccagaggcggtctttgccggggaagtgaacaaactgcgcgaggagcagttcaagcccattgaacaggtannnnnnnnnnnnnnnnnnnnnnnnnnnnnnnnnnnnnnnnnnnnnnnnnnnnnnnnnnnnnnnnnnnnnnnnnnn

SEQ ID NO: 174 - DNA, 1332 bp, Artificial Sequence
  Description of Artificial Sequence: Synthetic polynucleotide
  modified_base (1)..(54): a, c, t, g, unknown or other
  modified_base (111)..(111): a, c, t, g, unknown or other
  modified_base (130)..(132): a, c, t, g, unknown or other
  modified_base (288)..(288): a, c, t, g, unknown or other
  modified_base (438)..(438): a, c, t, g, unknown or other
  modified_base (586)..(586): a, c, t, g, unknown or other
  modified_base (588)..(592): a, c, t, g, unknown or other
  modified_base (606)..(606): a, c, t, g, unknown or other
  modified_base (642)..(642): a, c, t, g, unknown or other
  modified_base (645)..(645): a, c, t, g, unknown or other
  modified_base (657)..(657): a, c, t, g, unknown or other
  modified_base (684)..(684): a, c, t, g, unknown or other
  modified_base (972)..(972): a, c, t, g, unknown or other
  modified_base (1018)..(1128): a, c, t, g, unknown or other
  modified_base (1261)..(1332): a, c, t, g, unknown or other
nnnnnnnnnnnnnnnnnnnnnnnnnnnnnnnnnnnnnnnnnnnnnnnnnnnnnngatgttgagatgtggaaaataaagcggctcataaagtcgctggaagcagcacgaggnaatggaacttcaatgattnnnctgattatcccgccaaaggaccagattccgagagtggcaaaaatgcttgccgatgaatttggcacggcttcgaacatcaaatctcgagtgaacaggcaatccgtgctcggcgccatcacttccgtccaggctcgattaaaactttacaaccgaggncccgaaaatggtttggtcgtttattgcggcacaatcttgaccgaggatggaaaagagaagaaggtgaacattgactttgagcctttcaaacccgtgaacacgtcactctatttgtgcgacaacaaattccacacggaagcactgaacgtnttgctgattgatgacaacaagttcggattcattgtgatggacggaagcggatgtctgtttggcacactgcaaggcaatgccaaggaagtccttcacaaattctccgtggaattgccaaagaagcatggccgtggaggacaatcagcantnnnnnttgcccgactgagnatggaaaagcggcacaactatttgcgcaaagtggcnganatggccgtgganatgtacatcaagaacgacaaagtcacngtgacgggtcttgtgctcgctggaagtgctcaattcaaaacggagcttggacagtccgacatgttcgaccagagacttcaggcaaaaatcataaaaacagtggacatttcctacggaggcgagagcggcttcaacgaagccatcgagttggccgcggacacgctcaccgacgtcaagttcatcaaggagaagaaactgatcagctcatttttcgacgaaatttcccgggacaccaacaaagccatctacggagtcaacgagacgctggcagcattggaacaaggcgcngtggaaacactgatctgctgggagaatctggccatcctcaggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagcatcccattgctggagtggcttgccgaaaactacaagaaattcggcgccgtgctggagattgtcagcgacaagtcacaagaaggtgctcagtttgtgcgcgggtttggtgggttgggaggtttgttgnnnnnnnnnnnnnnnnnnnnnnnnnnnnnnnnnnnnnnnnnnnnnnnnnnnnnnnnnnnnnnnnnnnnnnnn

SEQ ID NO: 175 - DNA, 2022 bp, Artificial Sequence
  Description of Artificial Sequence: Synthetic polynucleotide
  modified_base (1)..(585): a, c, t, g, unknown or other
  modified_base (705)..(705): a, c, t, g, unknown or other
  modified_base (714)..(714): a, c, t, g, unknown or other
  modified_base (717)..(717): a, c, t, g, unknown or other
  modified_base (720)..(720): a, c, t, g, unknown or other
  modified_base (722)..(723): a, c, t, g, unknown or other
  modified_base (726)..(726): a, c, t, g, unknown or other
  modified_base (729)..(729): a, c, t, g, unknown or other
  modified_base (734)..(735): a, c, t, g, unknown or other
  modified_base (738)..(739): a, c, t, g, unknown or other
  modified_base (741)..(741): a, c, t, g, unknown or other
  modified_base (744)..(744): a, c, t, g, unknown or other
  modified_base (748)..(753): a, c, t, g, unknown or other
  modified_base (757)..(762): a, c, t, g, unknown or other
  modified_base (764)..(764): a, c, t, g, unknown or other
  modified_base (766)..(769): a, c, t, g, unknown or other
  modified_base (771)..(772): a, c, t, g, unknown or other
  modified_base (774)..(782): a, c, t, g, unknown or other
  modified_base (784)..(784): a, c, t, g, unknown or other
  modified_base (786)..(792): a, c, t, g, unknown or other
  modified_base (880)..(881): a, c, t, g, unknown or other
  modified_base (883)..(883): a, c, t, g, unknown or other
  modified_base (885)..(888): a, c, t, g, unknown or other
  modified_base (890)..(891): a, c, t, g, unknown or other
  modified_base (893)..(897): a, c, t, g, unknown or other
  modified_base (900)..(902): a, c, t, g, unknown or other
  modified_base (904)..(904): a, c, t, g, unknown or other
  modified_base (906)..(906): a, c, t, g, unknown or other
  modified_base (909)..(909): a, c, t, g, unknown or other
  modified_base (911)..(912): a, c, t, g, unknown or other
  modified_base (975)..(975): a, c, t, g, unknown or other
  modified_base (979)..(981): a, c, t, g, unknown or other
  modified_base (984)..(985): a, c, t, g, unknown or other
  modified_base (987)..(987): a, c, t, g, unknown or other
  modified_base (990)..(992): a, c, t, g, unknown or other
  modified_base (1002)..(1005): a, c, t, g, unknown or other
  modified_base (1009)..(1010): a, c, t, g, unknown or other
  modified_base (1014)..(1014): a, c, t, g, unknown or other
  modified_base (1017)..(1017): a, c, t, g, unknown or other
  modified_base (1020)..(1020): a, c, t, g, unknown or other
  modified_base (1024)..(1025): a, c, t, g, unknown or other
  modified_base (1027)..(1027): a, c, t, g, unknown or other
  modified_base (1030)..(1032): a, c, t, g, unknown or other
  modified_base (1034)..(1035): a, c, t, g, unknown or other
  modified_base (1038)..(1041): a, c, t, g, unknown or other
  modified_base (1045)..(1052): a, c, t, g, unknown or other
  modified_base (1055)..(1055): a, c, t, g, unknown or other
  modified_base (1058)..(1058): a, c, t, g, unknown or other
  modified_base (1061)..(1062): a, c, t, g, unknown or other
  modified_base (1068)..(1068): a, c, t, g, unknown or other
  modified_base (1070)..(1071): a, c, t, g, unknown or other
  modified_base (1074)..(1077): a, c, t, g, unknown or other
  modified_base (1081)..(1081): a, c, t, g, unknown or other
  modified_base (1083)..(1083): a, c, t, g, unknown or other
  modified_base (1086)..(1086): a, c, t, g, unknown or other
  modified_base (1092)..(1092): a, c, t, g, unknown or other
  modified_base (1095)..(1095): a, c, t, g, unknown or other
  modified_base (1098)..(1098): a, c, t, g, unknown or other
  modified_base (1107)..(1107): a, c, t, g, unknown or other
  modified_base (1110)..(1110): a, c, t, g, unknown or other
  modified_base (1120)..(1120): a, c, t, g, unknown or other
  modified_base (1122)..(1125): a, c, t, g, unknown or other
  modified_base (1127)..(1127): a, c, t, g, unknown or other
  modified_base (1131)..(1131): a, c, t, g, unknown or other
  modified_base (1134)..(1138): a, c, t, g, unknown or other
  modified_base (1140)..(1143): a, c, t, g, unknown or other
  modified_base (1146)..(1147): a, c, t, g, unknown or other
  modified_base (1149)..(1150): a, c, t, g, unknown or other
  modified_base (1152)..(1162): a, c, t, g, unknown or other
  modified_base (1164)..(1170): a, c, t, g, unknown or other
  modified_base (1173)..(1174): a, c, t, g, unknown or other
  modified_base (1176)..(1176): a, c, t, g, unknown or other
  modified_base (1179)..(1179): a, c, t, g, unknown or other
  modified_base (1182)..(1182): a, c, t, g, unknown or other
  modified_base (1187)..(1187): a, c, t, g, unknown or other
  modified_base (1192)..(1192): a, c, t, g, unknown or other
  modified_base (1197)..(1197): a, c, t, g, unknown or other
  modified_base (1200)..(1200): a, c, t, g, unknown or other
  modified_base (1203)..(1203): a, c, t, g, unknown or other
  modified_base (1206)..(1212): a, c, t, g, unknown or other
  modified_base (1215)..(1215): a, c, t, g, unknown or other
  modified_base (1218)..(1218): a, c, t, g, unknown or other
  modified_base (1221)..(1222): a, c, t, g, unknown or other
  modified_base (1225)..(1227): a, c, t, g, unknown or other
  modified_base (1231)..(1231): a, c, t, g, unknown or other
  modified_base (1234)..(1234): a, c, t, g, unknown or other
  modified_base (1236)..(1236): a, c, t, g, unknown or other
  modified_base (1240)..(1242): a, c, t, g, unknown or other
  modified_base (1245)..(1248): a, c, t, g, unknown or other
  modified_base (1251)..(1254): a, c, t, g, unknown or other
  modified_base (1259)..(1263): a, c, t, g, unknown or other
  modified_base (1269)..(1270): a, c, t, g, unknown or other
  modified_base (1272)..(1272): a, c, t, g, unknown or other
  modified_base (1275)..(1278): a, c, t, g, unknown or other
  modified_base (1284)..(1286): a, c, t, g, unknown or other
  modified_base (1289)..(1289): a, c, t, g, unknown or other
  modified_base (1293)..(1294): a, c, t, g, unknown or other
  modified_base (1297)..(1305): a, c, t, g, unknown or other
  modified_base (1307)..(1315): a, c, t, g, unknown or other
  modified_base (1318)..(1324): a, c, t, g, unknown or other
  modified_base (1327)..(1328): a, c, t, g, unknown or other
  modified_base (1330)..(1334): a, c, t, g, unknown or other
  modified_base (1337)..(1338): a, c, t, g, unknown or other
  modified_base (1340)..(1342): a, c, t, g, unknown or other
  modified_base (1349)..(1349): a, c, t, g, unknown or other
  modified_base (1353)..(1353): a, c, t, g, unknown or other
  modified_base (1356)..(1356): a, c, t, g, unknown or other
  modified_base (1359)..(1359): a, c, t, g, unknown or other
  modified_base (1361)..(1362): a, c, t, g, unknown or other
  modified_base (1365)..(1366): a, c, t, g, unknown or other
  modified_base (1368)..(1369): a, c, t, g, unknown or other
  modified_base (1374)..(1374): a, c, t, g, unknown or other
  modified_base (1377)..(1379): a, c, t, g, unknown or other
  modified_base (1381)..(1390): a, c, t, g, unknown or other
  modified_base (1395)..(1396): a, c, t, g, unknown or other
  modified_base (1401)..(1401): a, c, t, g, unknown or other
  modified_base (1403)..(1405): a, c, t, g, unknown or other
  modified_base (1407)..(1407): a, c, t, g, unknown or other
  modified_base (1461)..(1461): a, c, t, g, unknown or other
  modified_base (1502)..(1502): a, c, t, g, unknown or other
  modified_base (1505)..(1505): a, c, t, g, unknown or other
  modified_base (1651)..(2022): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaagcttacacctgacattgtacgcaactatctgcgcaataaagagaactgtgattgcatactgattttctatcatccaaaagtggcccagaaatcttatggacaggaaaaaagattnttctgcccnccnccntnngtntanctacnnggnnanggntggnnnnnncgcnnnnnngntnnnnannannnnnnnnngnannnnnnngaagcggttttacaacaatttgttcggtttaatgagcccagcagtgactatgactatgaagagccggttgcactgattggcattggtnncnannnncnngnnnnncannnantngantnntccaatggcaaagttaatggggagggaagcaaagatcaattggccaattccaaggattattgngcgnnnaanncnctnnncatcagcgannnngacnngcgnaantanttcnncntgnnngnncannnntttnnnnnnnncgnccntcnnttgggncnnttnnnntcanancgnatcaangtnatntccaaaccntcnaagaagaagnannnnangaanagnnnnnannnnaannanntnnnnnnnnnnnannnnnnnaanntngcnctnttcantcggnttcgntcncanacnnnnnnnacncgntanntgnnngtgnagnanggcnnnttnnnngcnnnntccannnnntggggnncnttnnnnattcannngcncgannacnnnnnnnnngnnnnnnnnnccnnnnnnntcnntnnnnncgnngnnntcatcanctanggntcnanngtnnanntggtngannncnnnnnnnnnnttgcnntgccnannntncgcattcgaaaggttgacaagcaaatggtgttgctggacccggccggacaagtngaaccagtgtcccaactgcacaaatgcgccttccaaatggntgnccaagagatgctctacctttgcctctcccatgacaaaatcattcagcaccaggcaattcgcatcgacgcccatcggcaccaaatcagtgacggtgccgcctggaccatcatttccacggacaaatccgagtatcgctgggccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 176 - DNA, 1401 bp, Artificial Sequence
  Description of Artificial Sequence: Synthetic polynucleotide
  modified_base (141)..(141): a, c, t, g, unknown or other
  modified_base (501)..(501): a, c, t, g, unknown or other
  modified_base (603)..(603): a, c, t, g, unknown or other
  modified_base (780)..(780): a, c, t, g, unknown or other
  modified_base (901)..(901): a, c, t, g, unknown or other
  modified_base (970)..(970): a, c, t, g, unknown or other
  modified_base (972)..(972): a, c, t, g, unknown or other
  modified_base (1002)..(1002): a, c, t, g, unknown or other
  modified_base (1023)..(1023): a, c, t, g, unknown or other
  modified_base (1101)..(1101): a, c, t, g, unknown or other
  modified_base (1116)..(1116): a, c, t, g, unknown or other
  modified_base (1124)..(1124): a, c, t, g, unknown or other
  modified_base (1393)..(1401): a, c, t, g, unknown or other
atgtcaattgcaccaacatatcgagcgcataagcccaatgtgcccattcttatggaggatattttcggttgggtgcgtgaaggcaatgcatttcaagttcgagtttggcttgatgatacagaacatgatttgaacgtcagngacgatcatgctttttcactcttacattgggctgcaaaagagggacatgtgtcaattgtggagatgctcctttctagggggacaagagtgaatgcaacaaatatgggcgatgacacgcctttgcatttggctgctggacacggacatcgacaagtcgtggtgaaacttctctcgcggaaagccgaagtcaatgtgcaaaatgaacatggcatgacgcccttgcactatgcttgcttctggggatatgagcaaatttgtgaagatttgatccgatctggtgcacttgtaactatgtgcaataaacggggattgacaccactggatgtttgccagccccaagttcgtcaatccatttataanattgccctaagcaatggacaaaatccgcaacaaaaaattcaatataccggagaaacttggcgaaatacaaaaacgaggtcaagagatgcaacatggtcaagntatactggcgtagacctgcaatcccttgcactcacaaagccaattgctcaatcacattcaggaactctttatcgtggcaagtggcaaggaaatgacatcgtggcaagagtgctgaatgttcccaacgttacccaacgaatttcgcgcgattttgctactgaattcccttctctcgantttttcgctagcgcgcataccaaccctgttcttgctgctgtaaatcagccaccgcaactaattttaatcagtcaattcatgccatttggatcgctctacaacgttctgcacgaacaatcanccgtcgtcatcgaccatacacaggcgataagatttgctctggatattgccaaaggaatgtcattcctcnanacactggatcagccaatacttcgctattanctcagctcaaaacatgttgtnattgatgaggacctcagcgccaaaatttctcttgccgatacgaaattttcatttcaggaagttggtcgcctctattcnccagcttggatggcnccagaagnattgcaacgttcacctgaatttttgaacacaagagcggcagacatgtggagttatgggatcttactttgggaattaaatactcgagaggtgccattttccgaactttctccaatggaggcggggatgaaaattgctcttgaaggacttagaatcacaattccgccagggatttcacgcaatatgttcaggatgatcaacatatgcctcaatgaagaccccggaagacggccaaattttgaccaaataataccgattctagagaagatgnnnnnnnnn

SEQ ID NO: 177 - DNA, 645 bp, Artificial Sequence
  Description of Artificial Sequence: Synthetic polynucleotide
  modified_base (1)..(72): a, c, t, g, unknown or other
  modified_base (81)..(81): a, c, t, g, unknown or other
  modified_base (127)..(127): a, c, t, g, unknown or other
  modified_base (132)..(132): a, c, t, g, unknown or other
  modified_base (165)..(165): a, c, t, g, unknown or other
  modified_base (207)..(207): a, c, t, g, unknown or other
  modified_base (401)..(402): a, c, t, g, unknown or other
  modified_base (405)..(412): a, c, t, g, unknown or other
  modified_base (414)..(422): a, c, t, g, unknown or other
  modified_base (424)..(431): a, c, t, g, unknown or other
  modified_base (489)..(489): a, c, t, g, unknown or other
  modified_base (491)..(491): a, c, t, g, unknown or other
  modified_base (631)..(645): a, c, t, g, unknown or other
nnnnnnnnnnnnnnnnnnnnnnnnnnnnnnnnnnnnnnnnnnnnnnnnnnnnnnnnnnnnnnnnnnnnnnnnggactttantacatgatcaccggccaaggagaccgcttcgatgttgcctggttcntgacngaaacaccaccccatatgtgggcaggcattggnattgctgcctcactttccctgtctgtcatcggcgctggaggnggaattttcacgactggctcatccattttgggcggtggtgtgaaagcgcccaggattcggacaaagaacctggtgtctatcattttctgtgaagccgtcgccatttttggcatcatcatggcgtttgtttttgccggaaaactttggcgtaagcaattctttatgttaattgaaaataaagatggaattctagnnatnnnnnnnnannnnnnnnncnnnnnnnnaatctttggaggcggccttaccgttggcttcagcaatttggtttgcggccttgcagtngntgttgttggatccggcgcagctttggcggacgcagcaaacccagctttattcgtcaaaatcctgattattgaaatttttgccagcgccattggactctttgggatgatcattgggattgttcaggtttttaagcattctnnnnnnnnnnnnnnn

SEQ ID NO: 178 - DNA, 606 bp, Artificial Sequence
  Description of Artificial Sequence: Synthetic polynucleotide
  modified_base (258)..(258): a, c, t, g, unknown or other
  modified_base (604)..(606): a, c, t, g, unknown or other
atgaaacttcttgccattttggtgatccgcaaggatccacaagcaaatacgacaacactcatgaagggagcctatgaattgaacagcttcagcttcttcacaagacgaaatgcacaggaattcatgcaattcacggctaaattggtcgcagaacggtcggcaacgcccagccgaagcagcatcaaggagggcgagtactttgtgcactgctatgtcagacacgacaatctggttggcgtatgcatgacagatgaggantaccaatcgcgagtggcgttcactttgctgaacaaggttttggccgactttgcagagcgggtgccttcccacgattgggctgcaattagaagtgagaatgattgcccatatgaccagttgccaatgttcctaacccgatggcagaatccgcgagaagcggacgcactcactcgcgtgcaggacgaagtggaggagaccaaggttgtgctgcacaacaccgtgcaagctgtgctggaacggggcgagaaaatggaggatttgatcaaggccagcgagaatttgtcggaccaaagcaaaatgttttacacgcaagcgcggaagatgaacaaatgctgtaactatgttnnn

SEQ ID NO: 179 - DNA, 1389 bp, Artificial Sequence
  Description of Artificial Sequence: Synthetic polynucleotide
  modified_base (1)..(231): a, c, t, g, unknown or other
  modified_base (492)..(492): a, c, t, g, unknown or other
  modified_base (532)..(903): a, c, t, g, unknown or other
  modified_base (927)..(927): a, c, t, g, unknown or other
  modified_base (932)..(932): a, c, t, g, unknown or other
  modified_base (937)..(937): a, c, t, g, unknown or other
  modified_base (984)..(984): a, c, t, g, unknown or other
  modified_base (1005)..(1005): a, c, t, g, unknown or other
  modified_base (1023)..(1023): a, c, t, g, unknown or other
  modified_base (1041)..(1041): a, c, t, g, unknown or other
  modified_base (1053)..(1053): a, c, t, g, unknown or other
  modified_base (1122)..(1122): a, c, t, g, unknown or other
  modified_base (1161)..(1161): a, c, t, g, unknown or other
  modified_base (1197)..(1197): a, c, t, g, unknown or other
  modified_base (1203)..(1203): a, c, t, g, unknown or other
  modified_base (1209)..(1209): a, c, t, g, unknown or other
  modified_base (1246)..(1389): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatcgatcccaacacaattggctttttggcggttggaacggaaacattggtggacagaagcaaaagcataaagtctgtgttgatggatttgttctccgggaacaccgacatcgagggaattgatgagaaaaatgcctgatttggtgggacacaagcactcttccatgccgttgattgggtttattcaaattacaagtttgagaagagatcagcaattgtggtgtgcgtggacattgccatttatgctcagggaccagancgatgcactggcggtgctggtgcgattgccttcctcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcgctgaaggcaagtggtgtngaagncgagnaaaagttgaacccacaccttgtttttggccgtcgaataggcaacatntacactccatctctttatgcncaactgttgttttacaanacaaaattttcacaaganatgcacaaacancggattttgatgttttcctacggcagcggatgtgttgcagcactttattccctgactttgaatcaagcnggatcctatgcattgataaagcagagtgcggaaagggcntttgaacgactggatgccagagtcaagtatgcgccngaacanttcacnaaaattttgggggctcgagaacggatcatccagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 180 - DNA, 3027 bp, Artificial Sequence
  Description of Artificial Sequence: Synthetic polynucleotide
  modified_base (66)..(66): a, c, t, g, unknown or other
  modified_base (93)..(93): a, c, t, g, unknown or other
  modified_base (99)..(99): a, c, t, g, unknown or other
  modified_base (148)..(148): a, c, t, g, unknown or other
  modified_base (186)..(186): a, c, t, g, unknown or other
  modified_base (198)..(198): a, c, t, g, unknown or other
  modified_base (201)..(201): a, c, t, g, unknown or other
  modified_base (217)..(411): a, c, t, g, unknown or other
  modified_base (567)..(567): a, c, t, g, unknown or other
  modified_base (699)..(699): a, c, t, g, unknown or other
  modified_base (892)..(3027): a, c, t, g, unknown or other
atgtcattgaacaattgggtaaatgatgagctgcacaaaattgccggttacagtgatcctacaacngttgcgtttatgatagcacaagcgaanaaatcnactgatcccgatgattttgttcaacgcctacagaacacaggttcatttnagataacaaaggacgttgtcaattttgctacccaattncttggcaaagtnccncatgcaggttattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaaagatgaaagttctgaatcggattttgaaaaattggaagaagatgcacagcgcgacatcgaagaacgtgacgcattggcaaagaggataaaggagcgggagaagaagaacactcggcatatcatgtccaaatcggaagctcgaagcatgaangaaaaagaggatatgatggacaaattgcgatatgaaagccgcaagagttacctttccaagcgcaaagaggataaacggatggaattggaggcacttgttcgggacgatgaacagctcttttcaaaagaaacnttgacgaagaaagaaaaattggatgcggaatatcggaaagaagtgctcaattttgtgataaaatatgacgaagccggcaatgtgctgaaagtgcctcgatatcatgttccggatgcttcatcaaaatcattccctaacgattatgtggaagagcaagatttgcctggtggagatggcgccgatgggaagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 181 - DNA, 2037 bp, Artificial Sequence
  Description of Artificial Sequence: Synthetic polynucleotide
  modified_base (1)..(168): a, c, t, g, unknown or other
  modified_base (210)..(210): a, c, t, g, unknown or other
  modified_base (229)..(229): a, c, t, g, unknown or other
  modified_base (243)..(243): a, c, t, g, unknown or other
  modified_base (276)..(276): a, c, t, g, unknown or other
  modified_base (360)..(360): a, c, t, g, unknown or other
  modified_base (534)..(535): a, c, t, g, unknown or other
  modified_base (549)..(549): a, c, t, g, unknown or other
  modified_base (576)..(576): a, c, t, g, unknown or other
  modified_base (597)..(597): a, c, t, g, unknown or other
  modified_base (624)..(624): a, c, t, g, unknown or other
  modified_base (652)..(652): a, c, t, g, unknown or other
  modified_base (654)..(654): a, c, t, g, unknown or other
  modified_base (675)..(675): a, c, t, g, unknown or other
  modified_base (684)..(684): a, c, t, g, unknown or other
  modified_base (687)..(687): a, c, t, g, unknown or other
  modified_base (747)..(747): a, c, t, g, unknown or other
  modified_base (793)..(793): a, c, t, g, unknown or other
  modified_base (795)..(795): a, c, t, g, unknown or other
  modified_base (828)..(828): a, c, t, g, unknown or other
  modified_base (840)..(840): a, c, t, g, unknown or other
  modified_base (843)..(843): a, c, t, g, unknown or other
  modified_base (846)..(846): a, c, t, g, unknown or other
  modified_base (856)..(856): a, c, t, g, unknown or other
  modified_base (867)..(867): a, c, t, g, unknown or other
  modified_base (885)..(885): a, c, t, g, unknown or other
  modified_base (938)..(938): a, c, t, g, unknown or other
  modified_base (993)..(993): a, c, t, g, unknown or other
  modified_base (996)..(996): a, c, t, g, unknown or other
  modified_base (999)..(1000): a, c, t, g, unknown or other
  modified_base (1041)..(1041): a, c, t, g, unknown or other
  modified_base (1056)..(1056): a, c, t, g, unknown or other
  modified_base (1065)..(1065): a, c, t, g, unknown or other
  modified_base (1074)..(1074): a, c, t, g, unknown or other
  modified_base (1077)..(1077): a, c, t, g, unknown or other
  modified_base (1083)..(1083): a, c, t, g, unknown or other
  modified_base (1113)..(1113): a, c, t, g, unknown or other
  modified_base (1125)..(1125): a, c, t, g, unknown or other
  modified_base (1254)..(1254): a, c, t, g, unknown or other
  modified_base (1384)..(1386): a, c, t, g, unknown or other
  modified_base (1456)..(1456): a, c, t, g, unknown or other
  modified_base (1458)..(1470): a, c, t, g, unknown or other
  modified_base (1475)..(1475): a, c, t, g, unknown or other
  modified_base (1491)..(1491): a, c, t, g, unknown or other
  modified_base (1510)..(1510): a, c, t, g, unknown or other
  modified_base (1520)..(1521): a, c, t, g, unknown or other
  modified_base (1584)..(1584): a, c, t, g, unknown or other
  modified_base (1867)..(1869): a, c, t, g, unknown or other
  modified_base (1936)..(2037): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaattcccagcaatgaggtcatcattgaccgtctcaaactngaggatttactgaagcgcngatttttctacgancaaagttttgcgatctatggcggtgttggagtnctctatgattatggcccgatgggatgttcgcttaaaagccaaatggtgcaactctggcgtactcatttcattttggaagagggnatgctcgaagtcgaatgcacttcattgactcccgaaaatgttttgaatgcatccggccatgtggatcgtttcattgattggatggtcaaggacaaactcacgggtgcttgtttccgagcggaccatttgataaagaatcaggcggaatcacttatcaaagacaagaagacttcnnctgatgtgaagcancaactggaggaagtactcatccgactngatggattcagttgcaagganatggaggaaacaatcaacaaattcaanttcaaatccccactcactggcaatgatntnaccgagcccgtatccttcaanctgatgttnccnactgaaattgggccaactggcgattttcgtgcctatctccgaccagaaactgcacagggnattttcatcaatttcaagcgattgttggagttcaatcagggacgcntnccatttgctgctgcccaaattggtactggcttncgaaatgaaatntcnccnaggcaaggantgattcgtgtncgcgagttcaccatgtgngaaattgagcattttgtggacccatcaaacaaaaaacatccaaaatttggacnagtggccaatgttgaaatggatttattctcggcatgcaatcaaatggatggaaanggngcnnaaaagatgacaattggcgaagctgtggaaaagggaattgtngacaatgaaacactnggatattanatggcacgnacncatctnttcctgcttgctgttggcattgcgccgganaagcttcgcttncgtcaacatctctcaaatgaaatggcgcattatgcaaaggattgctgggatgcagaatgtctgactagctatggctggattgaatgcgtaggaaatgcggatcgagcttgctacgacttggatcaacantacaaagcaactggcgtcaaattggtggcggagaaaaagcttgataagccaaaacaaatggaagtgattgaagcggcgccaaacaagtctgccatcgggaaaatgttcaagactaattcaaaagaggttnnnactttattgcaaaacacaaagtttgttcatggaataaccaataaataatctcttaatttcagcaaatacnannnnnnnnnnnnnaatgncaaaagcattgtgctngattctgatctggtgaagnttaagcgttnngagaagacagtccacgtggaagaagttaccccatcggtgattgagccctccttcggcattggncgcgtgatgtacgccgttttggagcattccttccgacagcgagaaggcgatgagaagcgttcgtatcttgaattgccaccaataattgcaccaataaaatgttcaattctgccaatcagccccaatgaacgactttatcccatcattcaagctgtccgagaggagctaaccagtcgggagataagctcaaaaattgatgacagtacgggctcaattgggcggcggtatgcgcgaacagacgaaattggcattccctttggcataaccgtagacttcgagtcgnnngaagccgagccatggactgtaacattgcgacatgctccaacaatgcagcaaatacgattaaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 182 - DNA, 3561 bp, Artificial Sequence
  Description of Artificial Sequence: Synthetic polynucleotide
  modified_base (1)..(12): a, c, t, g, unknown or other
  modified_base (352)..(378): a, c, t, g, unknown or other
  modified_base (697)..(697): a, c, t, g, unknown or other
  modified_base (720)..(720): a, c, t, g, unknown or other
  modified_base (726)..(727): a, c, t, g, unknown or other
  modified_base (729)..(729): a, c, t, g, unknown or other
  modified_base (732)..(733): a, c, t, g, unknown or other
  modified_base (903)..(903): a, c, t, g, unknown or other
  modified_base (1029)..(1029): a, c, t, g, unknown or other
  modified_base (1087)..(1087): a, c, t, g, unknown or other
  modified_base (1089)..(1089): a, c, t, g, unknown or other
  modified_base (1092)..(1092): a, c, t, g, unknown or other
  modified_base (1095)..(1095): a, c, t, g, unknown or other
  modified_base (1098)..(1098): a, c, t, g, unknown or other
  modified_base (1114)..(1114): a, c, t, g, unknown or other
  modified_base (1116)..(1116): a, c, t, g, unknown or other
  modified_base (1122)..(1122): a, c, t, g, unknown or other
  modified_base (1143)..(1143): a, c, t, g, unknown or other
  modified_base (1157)..(1157): a, c, t, g, unknown or other
  modified_base (1332)..(1332): a, c, t, g, unknown or other
  modified_base (1515)..(1515): a, c, t, g, unknown or other
  modified_base (1743)..(1743): a, c, t, g, unknown or other
  modified_base (1924)..(1924): a, c, t, g, unknown or other
  modified_base (1932)..(1932): a, c, t, g, unknown or other
  modified_base (2019)..(2019): a, c, t, g, unknown or other
  modified_base (2175)..(2175): a, c, t, g, unknown or other
  modified_base (2190)..(2190): a, c, t, g, unknown or other
  modified_base (2196)..(2197): a, c, t, g, unknown or other
  modified_base (2238)..(2238): a, c, t, g, unknown or other
  modified_base (2284)..(2382): a, c, t, g, unknown or other
  modified_base (2488)..(2490): a, c, t, g, unknown or other
  modified_base (2494)..(2494): a, c, t, g, unknown or other
  modified_base (2527)..(2529): a, c, t, g, unknown or other
  modified_base (2632)..(2634): a, c, t, g, unknown or other
  modified_base (2636)..(2638): a, c, t, g, unknown or other
  modified_base (2640)..(2644): a, c, t, g, unknown or other
  modified_base (2646)..(2653): a, c, t, g, unknown or other
  modified_base (2655)..(2655): a, c, t, g, unknown or other
  modified_base (2658)..(2659): a, c, t, g, unknown or other
  modified_base (2661)..(2661): a, c, t, g, unknown or other
  modified_base (2878)..(2880): a, c, t, g, unknown or other
  modified_base (2965)..(2970): a, c, t, g, unknown or other
  modified_base (3196)..(3561): a, c, t, g, unknown or other
nnnnnnnnnnnnaatacacccaagacccgagtgattgaggtgcgcaaaatcgaggaacaaatccaacaggaatgggcaaatcgcaaagctttcgagtcggatgcgcccgaagagcccaaggccaagtacatgacaacctttccattcccctacatgaatggccgtctccatctgggccacacattcacgctgtcaaagtgcgagttctcggccggctaccagcgcctccggggcaaacgctgcctgttcccgtttgctttccattgcacggggatgccaatcaaggcttgtgccgacaagttgaagcgggaaatccaactctatggcaatcctccgcaattcccggccgatnnnnnnnnnnnnnnnnnnnnnnnnnnnaatgcaattgcggaaatcacaaaggacaaggcgaagggaaagaagagcaaagccgttgccaaaacggttgcagccaagtaccaatggcaaatcatgcgctcactgggcttggaagacgcagaaattgcgcagttcgcggaggcaacccattggctgacttatttcccggacaaatgcaaagcggatttgcgctccatgggactcaaggtggactggcgacgagcatttgtgacgaccgatgtgaacccattcttcgactcatttgtacaatggcaattccgaaagctgaaggaggcgaaactcattgactttggcaaanggtacacaatttactcgccaaangatggnnanccnngcatggaccacgatcgctcaaccggggaaggcgttggcccacaggaatacacactgatcaaaatgaaggttctcgatccgaagccaaaagtgttggagaagttggaaaaacccattttcctggttgccgccactctccgaccggagacaatgtacggacaaacaaatgcntttttgcacccggacatcgcctattccgcattttacattggcgagaagggcgaggaaatcttcatagccaccgaacgtgccgcccggaacatggccttccaggggatgtcaccggaagaggggaanatatgcttcgttgagggacttgagaaagtgaaaggcatccagctgatgggctgtgcgntncgntcnccnctggcaccattcgagngnatttangcccttccaatgcttacaatnaaggatgacaaagntactggtgtggtcaccagcgttccttcggactctcccgacgattatgcggccttggttgacctgaagaagaaaagggctctgtgcgagaagtaccaaattgactttgaaatggtgaagccctttgagccaatcccaatcatggaaattggcgaatatgggcaactggcagccagntacatgtacaagaagttgggcattacaagccaaaatgacagacagaaactggaagaagccaagaaggaaatttacctgaaaggattttaccaaggggtaatgctggttggcgactacaagggtgagcgcaccgaaaacgtgaaaaagcgcatccaagaggacatgattcgtgatgggacggcntgcaaatatgtggagcccgagaagcgcattatttcacggtcgggcgatgaatgtgtggttgcactctgcgatcaatggtatctgaattatggaaagcccgaatggaagcaagccaccaaagacctgctggccaaaatgaacacttactcggaggaagtgcgacgcaattttgagcacaccatcgactggctgcatgaatacgcttgttcgcgctcttatggactcgcntcaaaattgccctgggacccgcaatacttgattgaatctctgtcggactccaccatttacaatgcatattacacggtggcccatctgctccagggcgacatttatagtgcggaaaagccgggagccctccaaattgcagctgaccaaatgaccgatgcggtttgggactacatcttccagnatgctccntacgatgccagcaaaatgcccgtggaagaggagaagttgaagaggatgcgacaggaattcgagtattggtatccggtggacatggangtttcgggcaaggatctgatccaaaaccacttgacctactacatcttcaaccatgtcgccatctggaaggatcgtccccaattttggccagtcggaattcgtgccaacgggcatttgctgttgaacaatgagaagatgtcgaagaacacgggcaanttcatgacccttttngaggcnnttgagcgcttttcggctgacggcatgcgaatggcattggcngatgccggcgatgccatcgaggatgcaaatttcatgtttgaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcggaccgggtgtttgccaatgagatggaccgactgattgcgctgaccgcggagcactacgagcgcaccctttacaaggaagcattgaagaccgggttctttnnntttnagactgcacgtgacaattatcgccaactctgcnnnggcagtgatgagcagatgaacgccgagctgatcatgcgtttcatcgaaacccaggcaatcattctttcgcccatctgcccgcacatcacagagcatatctggnnncnnntnnnnnannnnnnnntnatnntnaatgaaagttggccagccgtctcaaccgttgaccaaattctggtgcaacagagcgaattccttcaccgcgcggtcagcgacttccgccaaagacgcgaagccaaattgaacccaccaaagaaggccgcaaagaagcagctattgccgcccaaatccgcaacaatttatgtggccaagaaatatccggactggatggagcgagtcatcaaacaattgnnngcggaaatttatcagaaaaacggcttcttacccgacaaccgtgctcttcgggaactgcttggcccagcaaacggcgttggagagnnnnnngaggagcgcatggccttcacccagttcatctccaacaaggtcacggaacttggcccggcagctttgaatcctgaggaaacctttgaccaacgggaagtgctcaaccaagtcgaagactacttgctggcaactctgcaactggaacagctttcaatcgtggacacctcaaacccaggcatctcggcagaaacggcaaagtcatgctctccgggagccccattcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 183 - DNA, 807 bp, Artificial Sequence
  Description of Artificial Sequence: Synthetic polynucleotide
  modified_base (1)..(126): a, c, t, g, unknown or other
  modified_base (150)..(150): a, c, t, g, unknown or other
  modified_base (261)..(261): a, c, t, g, unknown or other
  modified_base (276)..(276): a, c, t, g, unknown or other
  modified_base (279)..(279): a, c, t, g, unknown or other
  modified_base (312)..(312): a, c, t, g, unknown or other
  modified_base (336)..(336): a, c, t, g, unknown or other
  modified_base (360)..(360): a, c, t, g, unknown or other
  modified_base (576)..(576): a, c, t, g, unknown or other
  modified_base (763)..(807): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaatatgtgattgatgagganaagcgcaagcgattgactggatttggcctttacattgcccaatgtttgcccaagtttgtacaacaagttcagtttgccggaggtgatgaattggagttgctaattcacccnagcggtgtgctaccngtnatggccttcctgaaaggccatcatcctgcgcanttcacaaatttcatattcgcttgnggtgttgatgtgccaacaaggaanaaccgttttgaggttgtctacgctttgctttcaattcgctacaatgcccgggtcagagtgcggacatacacattcaagattgccccattggactcaatcacgtcaattttctcgggagcagaatggtacgagcgcgaaatctacgacatgtatggggtctggttcaataaccacccagatctgcgacgcatcctcactgattatggatttgaaggncatccacagaggaaagatttcccgctgagtggctatcatgagttgcgctatgacccagaattgatgcatgttgtgtacgaacccacggaaatggcacaagaattccgcaaatttgacttgaacaccccgtgggaagtcttccctgcattccgggattcgtcaattactgccggctacaatttgatannnnnnnnnnnnnnnnnnnnnnnnnnnnnnnnnnnnnnnnnnnnn

SEQ ID NO: 184 - DNA, 2568 bp, Artificial Sequence
  Description of Artificial Sequence: Synthetic polynucleotide
  modified_base (1)..(66): a, c, t, g, unknown or other
  modified_base (99)..(99): a, c, t, g, unknown or other
  modified_base (102)..(102): a, c, t, g, unknown or other
  modified_base (109)..(109): a, c, t, g, unknown or other
  modified_base (168)..(168): a, c, t, g, unknown or other
  modified_base (180)..(180): a, c, t, g, unknown or other
  modified_base (186)..(186): a, c, t, g, unknown or other
  modified_base (202)..(202): a, c, t, g, unknown or other
  modified_base (216)..(216): a, c, t, g, unknown or other
  modified_base (231)..(231): a, c, t, g, unknown or other
  modified_base (255)..(255): a, c, t, g, unknown or other
  modified_base (270)..(270): a, c, t, g, unknown or other
  modified_base (276)..(276): a, c, t, g, unknown or other
  modified_base (282)..(282): a, c, t, g, unknown or other
  modified_base (333)..(333): a, c, t, g, unknown or other
  modified_base (351)..(351): a, c, t, g, unknown or other
  modified_base (369)..(369): a, c, t, g, unknown or other
  modified_base (444)..(444): a, c, t, g, unknown or other
  modified_base (465)..(465): a, c, t, g, unknown or other
  modified_base (474)..(474): a, c, t, g, unknown or other
  modified_base (543)..(543): a, c, t, g, unknown or other
  modified_base (555)..(555): a, c, t, g, unknown or other
  modified_base (558)..(558): a, c, t, g, unknown or other
  modified_base (597)..(597): a, c, t, g, unknown or other
  modified_base (679)..(679): a, c, t, g, unknown or other
  modified_base (681)..(681): a, c, t, g, unknown or other
  modified_base (1342)..(1342): a, c, t, g, unknown or other
  modified_base (1344)..(1345): a, c, t, g, unknown or other
  modified_base (1348)..(1355): a, c, t, g, unknown or other
  modified_base (1358)..(1361): a, c, t, g, unknown or other
  modified_base (1363)..(1369): a, c, t, g, unknown or other
  modified_base (1371)..(1373): a, c, t, g, unknown or other
  modified_base (1375)..(1375): a, c, t, g, unknown or other
  modified_base (1378)..(1381): a, c, t, g, unknown or other
  modified_base (1383)..(1385): a, c, t, g, unknown or other
  modified_base (1387)..(1387): a, c, t, g, unknown or other
  modified_base (1390)..(1391): a, c, t, g, unknown or other
  modified_base (1393)..(1393): a, c, t, g, unknown or other
  modified_base (1398)..(1399): a, c, t, g, unknown or other
  modified_base (1432)..(1433): a, c, t, g, unknown or other
  modified_base (1467)..(1467): a, c, t, g, unknown or other
  modified_base (1470)..(1470): a, c, t, g, unknown or other
  modified_base (1506)..(1506): a, c, t, g, unknown or other
  modified_base (1539)..(1539): a, c, t, g, unknown or other
  modified_base (1548)..(1548): a, c, t, g, unknown or other
  modified_base (1551)..(1551): a, c, t, g, unknown or other
  modified_base (1560)..(1560): a, c, t, g, unknown or other
  modified_base (1794)..(1794): a, c, t, g, unknown or other
  modified_base (1833)..(1833): a, c, t, g, unknown or other
  modified_base (1917)..(1917): a, c, t, g, unknown or other
  modified_base (2007)..(2007): a, c, t, g, unknown or other
  modified_base (2028)..(2028): a, c, t, g, unknown or other
  modified_base (2106)..(2106): a, c, t, g, unknown or other
  modified_base (2109)..(2110): a, c, t, g, unknown or other
  modified_base (2239)..(2373): a, c, t, g, unknown or other
  modified_base (2497)..(2568): a, c, t, g, unknown or other
nnnnnnnnnnnnnnnnnnnnnnnnnnnnnnnnnnnnnnnnnnnnnnnnnnnnnnnnnnnnnnnnnngaggctgaagatattgcatatgaagaggatatnatncgaaacncaggcttacttcgtccatgggaacgctatattgaacacaaaataaagacaaaggctganccgaaacaagtncggctngtctttgaacgtgcantgaagctcttcaancgcagttacaaactntggtatagttacctgaaatacagncgccgaacaattgcncacaancctccnactgatattgcttacgcgcatctcagcgatgcctacgaacgctgtttagtntttctcaataagatgccncggatttggattgattantgcaatgtgatgatccgccgtggcttgatcactgaaacaaggcgtgtgttcgatcgttcacttcgtgctttgccnatcactcaacacatgcgcatntggccactntacattgactttgtcacaaaatacaacatacccgacacaacaatccgtgtctatagacgctttctcaangtttatcccgcnggnagagaagattttgttgaatatttgaaacaaattgacaancttgatgaagcagcacaacaattggcactgcttgtcaacgaggataaagcagttagcgagaaaggcaaaacaggacaccaantntggactgaactgtgtgatcttatttcgaaaaacccaaacaaaatttattcattgcgcgtggagcctataatacgacaaggcatttcgcgctatacggatcaagttggtgttctctggttggctttggctgaatactatattcgaacaccaaattttgaaaaggcccgggatatctttgaagaggccatgggtttggttaaaacagttcgcgattttacgcaaatttttgatgcctacagcaaatttatggagagggttacatcattgaagatgaaagaattggagcaagccggacaaatggaagaggaattggaacttgaattggtgatgacacgctttgaacatttgatgaacaggcgcccgcttttactgaacagcgtgctcttacgacaaaacccacacaatgtccatgaatggttgaatcgtgttcaaatttacgaatctgaaccagaaaatcaaattgcaaccttcgaggaggcggtttctactgtggatccgaaactgcaagttggtaaactaagccaattgtggattgcttttgcgaagctgtatgagcgatttggtgaaatggaggaagcaagaaaggtttttgagaaagctgtccaagtaaactacacaaaagtggatgaacttgctcaagtttggtgcgaatacgcagagntnnaannnnnnnncannnntnnnnnnntnnntnttnnnntnnngngannancaacnncgccaccacggaaaggagactatgatgaatctnntaaagtgcaatccaaagtgttccgttcactgaanctntggtcattgtacgctgacattgaagaatcgcttggntcagtggatagttgccgcgaaatctatgatcgnatgatgganctncgaattcanacgcctcaaactgtcataaattacgcacttttccttgaagagaaccaatatttcgaagatgcttttaaggcttttgaaaagggaattggtcttttccgatggccattggtctttgatgtttggaatgtctatctgacaaaattcatgcagcgctatggcggtaaaaaactcgaaagagccagggatttgtttgagcaatgcttggataaatgcccaccaaaatatgcaaaaatnatctatttgctgtatgctaaattggaagaggagcatggnttggcacgacatgcaatggaggtttacaatcgagcgacagatgccgtggacaaagatgaaaagcacttgatttacaatgtttanatcaagaaagccatggaattttatggaataactaaaacaaggcccatctttgaatcggcaattgaaaggcttccagaagatagatctcgngaaatgagtatgcgatatgcncaagtggaacgtaatctgggagaaattgaccgggcaagagcaatttacgcgcattgtgctgaaatatgcgatccaagngtnnatccgcagttttgggagacatggaaagaatttgaagtgaagcatggaaatgaggataccattcgtgaaatgcttcgcgtgaaacgttcagttcaagcaacctataacaccaatgtgaactacatgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcgcatttcctttattcgcggtgaaagcaaaacaacccaagaaaaaactgtcgagaatcccgaagagattgacattgataatgttgaagaagaagagcaggaggatggtaatcaaggaaatnnnnnnnnnnnnnnnnnnnnnnnnnnnnnnnnnnnnnnnnnnnnnnnnnnnnnnnnnnnnnnnnnnnnnnnn

SEQ ID NO: 185 - DNA, 1542 bp, Artificial Sequence
  Description of Artificial Sequence: Synthetic polynucleotide
  modified_base (144)..(144): a, c, t, g, unknown or other
  modified_base (882)..(882): a, c, t, g, unknown or other
  modified_base (1044)..(1044): a, c, t, g, unknown or other
  modified_base (1129)..(1323): a, c, t, g, unknown or other
  modified_base (1501)..(1542): a, c, t, g, unknown or other
cttcaacatgtaaaacaagaattcacggagggtcttatagcttgctgtgaatgcggcactccaatagcaccaaaccaggcgaatatgtgcctaggatgtcttcgatcaagagttgatatcacagaagggattctaaagcaacancaattgcaatcttgccgcaattgcagtcgttattttacgcctccaaacagttgggcttacgcagaattggaatccaaagaactgatgtcaatttgcctgaatcgcctgaaatccacaatgcaaaaagttcgtctcatcgatgccgctttcatttggactgaaccccattccaaacgtgtgaaggtgaagctgaccatccagaaggaagtgttctctcgagctgttctccaacaatcatttgttgtcgaatttgtcattctcaatcagatgtgcgatgaatgccgccgctttgaagccaaggactattggcgcgcttgtgttcaagttcggcagcgttgcgactacaagaaaacgcttttctacctagagcagcttttgttgaagcatggggctcaagggaaggcgagcagcataaagccagtgccaaccgggattgacttttactttccaagacagcaggaagcgaggaaacttgtggacttcatcatctcctcacttccatcaaaattccaacattctcagcaattgatcacacacgatgtgcgcaacaattactacgattacaagcacacctattgcatcgatgttgtgcccatcatcaaagatgcgctcatttgcctgccaaagcatttggcccaacaatactccaacattggccagtttgtggtgtgcttgagagtcaccgaagtcatcacattgatcaacccaatgactctccaattgcatgaagtcaacacnattacttattggaaggatccttttgatattctgactcatcccaaagcgttgactgaattctatgtgttggacgttgaggaaatagaaaatgcggccgcaccacaggggcacggcagtatttccaaccgacacaaactgtccgatgtttgggttgttagatgngaccaggtggggcatccagaagcgaaatcgatttgttgtcgaactcatcttggccatttgctcaatcccggagataccgttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaggaatttatggacgacattgaagaagatccaaaattgcgcgagaagatcaatatttacaagaaggctcacaatcagccatcaatttccacagaagaggatgaagcggttgaaaatggtccaaccttggaagaaatgctcgaagatttggatattgatgatgttgatatggagnnnnnnnnnnnnnnnnnnnnnnnnnnnnnnnnnnnnnnnnnn

SEQ ID NO: 186 - DNA, 2652 bp, Artificial Sequence
  Description of Artificial Sequence: Synthetic polynucleotide
  modified_base (1)..(99): a, c, t, g, unknown or other
  modified_base (175)..(177): a, c, t, g, unknown or other
  modified_base (433)..(433): a, c, t, g, unknown or other
  modified_base (437)..(440): a, c, t, g, unknown or other
  modified_base (442)..(442): a, c, t, g, unknown or other
  modified_base (445)..(447): a, c, t, g, unknown or other
  modified_base (449)..(451): a, c, t, g, unknown or other
  modified_base (453)..(453): a, c, t, g, unknown or other
  modified_base (459)..(459): a, c, t, g, unknown or other
  modified_base (607)..(669): a, c, t, g, unknown or other
  modified_base (745)..(747): a, c, t, g, unknown or other
  modified_base (931)..(1269): a, c, t, g, unknown or other
  modified_base (1366)..(1587): a, c, t, g, unknown or other
  modified_base (1852)..(1875): a, c, t, g, unknown or other
  modified_base (2218)..(2220): a, c, t, g, unknown or other
  modified_base (2290)..(2290): a, c, t, g, unknown or other
  modified_base (2328)..(2328): a, c, t, g, unknown or other
  modified_base (2331)..(2331): a, c, t, g, unknown or other
  modified_base (2337)..(2337): a, c, t, g, unknown or other
  modified_base (2347)..(2347): a, c, t, g, unknown or other
  modified_base (2379)..(2379): a, c, t, g, unknown or other
  modified_base (2426)..(2426): a, c, t, g, unknown or other
  modified_base (2484)..(2484): a, c, t, g, unknown or other
  modified_base (2487)..(2487): a, c, t, g, unknown or other
  modified_base (2490)..(2490): a, c, t, g, unknown or other
  modified_base (2508)..(2508): a, c, t, g, unknown or other
  modified_base (2510)..(2510): a, c, t, g, unknown or other
  modified_base (2538)..(2538): a, c, t, g, unknown or other
  modified_base (2548)..(2652): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattggatcagctgaatgcacaccccgaattttgctgctatcttctctacattctcagcaaactccaagaagagnnncaggttgcgcaccgcgcattgagcggcctcctgttgaagaacaccatcaagcagaattggcacaacattcccgagcagattcgccactacctgaagcgcaactgctttgccgccattggggacccatcgtcgctggtccgtgccacagttggcatcatcatcacgaccatatttctgcacgagagcgtccagggctggcccgagctgttgcccacgctttgccagtttttggacaaccaggatgcgaatgttattnaggnnnngnttnnngnnntncaaaanatctgcgaggattccgccgaccgactgggccaaaacgagatcaacttggtggtgtccaaggcgttggtgttcttcaactcgcccatggccaagctgcggtcgctgtcggtgaacactgtgaactgcattctgctggtccagaatgaannnnnnnnnnnnnnnnnnnnnnnnnnnnnnnnnnnnnnnnnnnnnnnnnnnnnnnnnnnnnnncaggaagtccaaaagcaactttgccgttccctcacgcttctgctggaaagtttcattgaaaaaattgcgccccatnnnccgaacatctccgagttcatgctgatgcgcacccaggacaccaacgatgagactgcgctggaggcctgtgaattctggctggcattcgccgagaacccgcagctgtgcaaggaagtgctggcgccgattctgccaaaactgctgcccgtgctcatcaagtgcatgcgctactccgagacggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccatttgcccgacctgatcccctacctgatccactcactgcaacacaaccgcgcactggtccgctcaatcacgtgctggaccctgtcccgctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctgatcctgtacgacgcagtgggcaccctggcggacagtgtgggcggcaacctggccgaaccaccctacgtggacatgctgatgcaaccgctcatggagaaatgggccatcctcaaggacgacgacaaggagctgttccccctgttggagtgcatctcctcggtggccaccgccctccactgctccttcctgccctacacggagccggttttccaacggtgtgtgcacctcatctccaacacgctcagccagagtcagcagnnnnnnnnnnnnnnnnnnnnnnnngaccaaccggacaaagacttcctcattgttgcccttgacctcctctctgaactgaccgaagccctgcgggactacattgaaccgctgctggaacaatccaatttgatccatctggtctacatttgttcacaggacccaaccaacgaagtccgtcaaagttcgttcgcactgctcggcgacttggccaaagcgtgctatatccatttgcaaccaaacgtgcaccagttcatcccaatcctcgcacaaaacctcaacccggaccatgtgtcggtgtgcaacaacgcgatctgggcgctgggcgaaatttccatgaaaattggcgaccaaatgcgccaatacgtgnnncccatcattttgccgcagctgatccatgtgatgaaccgggacaaagggccgaaaacgctgctggagaatncagcaatcacacttggccgtttcggactgtcctgcagngcngaggtntccccctacntggccgacttcatccggccctggtgcctgtcnctgcggaatgtgcgcgacaacgaggagaaggagtccgccttccgggntctctgcctgatgatcaactgcaatccacagggcgttgccgcctacttcattttcctntgngangcaattgcctcgtggtcnangcccagtgaggatttgcgcttcatgttnagccgggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 187 - DNA, 1011 bp, Artificial Sequence
  Description of Artificial Sequence: Synthetic polynucleotide
  modified_base (1)..(3): a, c, t, g, unknown or other
  modified_base (295)..(336): a, c, t, g, unknown or other
  modified_base (592)..(1011): a, c, t, g, unknown or other
nnntttggtaattttctgggtatgggcgaaacggcctcagcattctcggtccaattgcgctgcttttctgcgccattctttggcaaatatgacacagagaagatcaacgaactcaactatggtggcaagatacttctacccaactcatgccttgacaaccttattcgtcgccatatccaatggcccatgctgttcaaattgaccaatatcgagcaccagaaatcaactcatgcgggagtgttggaatttctagccgaagagggaaagtgctatctgccttcatgggttttgaaannnnnnnnnnnnnnnnnnnnnnnnnnnnnnnnnnnnnnnnnnagttcgcttccgccagccacctatgcaaagttcaagcccatgtccaccgatttctatcacgtcaccaatccaaaggccatgttggaggttgaattgcgaaaattttcctgtcttaccaaaaatgacgtgattgcggtccagtataatgagcaagtctttgaattcaaagttatggagttgaagcctcagaatgcggtgacaatcattgaatgcgacattaacattgaatttgatgctgccgagggttatgttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 188 - DNA, 1773 bp, Artificial Sequence
  Description of Artificial Sequence: Synthetic polynucleotide
  modified_base (1)..(24): a, c, t, g, unknown or other
  modified_base (177)..(177): a, c, t, g, unknown or other
  modified_base (420)..(420): a, c, t, g, unknown or other
  modified_base (510)..(510): a, c, t, g, unknown or other
  modified_base (657)..(657): a, c, t, g, unknown or other
  modified_base (817)..(930): a, c, t, g, unknown or other
  modified_base (1371)..(1371): a, c, t, g, unknown or other
  modified_base (1668)..(1668): a, c, t, g, unknown or other
  modified_base (1686)..(1686): a, c, t, g, unknown or other
  modified_base (1695)..(1695): a, c, t, g, unknown or other
  modified_base (1750)..(1752): a, c, t, g, unknown or other
  modified_base (1754)..(1754): a, c, t, g, unknown or other
  modified_base (1756)..(1773): a, c, t, g, unknown or other
nnnnnnnnnnnnnnnnnnnnnnnngaagacagtctttacccaatcgctgttctcattgatgaactcagaaatgaggatgtccagcttcgtctcaattcgatacgcaaactctcaacgattgcgcttgcacttggggttgagcgaactcgcaaggaactcattcaattcttgacagcnacgatttatgacgaggatgaagtacttcttgcgctggctgaacaattaggcaactttacgccactggttggtggatctgaatatgtccattgcttgctgccaccattggagaacctggctaatattgaggagactgttgtccgtgacaaagcagttgagtcactgcaaaaaattgccgacaaacattctgctgcgcaattggaggaatatttcatcccaatgatccttcgactcgcatcggangattggtttacttcccgcacatctgcttgtggactgttcagcgttgcttatgcccgagccaatcccgcacagaaaactgaacttcggggngctttccgaagcctttgccgtgatgacacaccaatggtccgtagagcggctgcctccaaattgggggatttcgccaaagtgcaagaagaagacttcctcaaaaacgatgttgtgcaaatgttcgaggagttggcaaaggatgaacangattctgtgcgtcttctttcggttgaggcgggcatagtcattggattgttgcgtgaagatgctgcaaagctggcacatgtcaaaccgattgtcaaggatcttgtccaggacaaatcatggcgcgttcgctacatggctgctgttaagattgtcgaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcaatgctctccccgaagaaggacgcaaaaaaggcatcattgaggaaattttgcccgtcataaagccgcttacgtcggatgcaaaccaacacgtgaagattgctttggcgcatgtcgttatgggattggccccacttctggggaatcaaagcactgttgagcatttgttgcccattttcttggcaatgctgcgcgatgacacgcccgaagtgaggctgaacatcatttcttctcttgacaaggtcagcgacgtgattggtgcggatgaattgcaatattctctgctgccggcaatcattgatttggcacaggacgggaagtggcgtgttcgactcgcacttgtcgaatacatgcccttgttggctgaacaacttgggcaaaaattctttgacgagaaactcttgaagctttgcatgaattggcttaccgaccatgtntatgcaattcgagaagcagcaaccgccatcctcaaacaattggccgaaaaatttggcgcagaatgggcagtgaaatcggttcttccaaaggttattgaactcgcatcggacagcaactacttgcaccgaatgacatgcctgttctgcttcaacactttgtgcgaagccatgggcaaggacaatgtgctgcgtgaaatgttccccaccattaaatctctctgtgacgaccaagtcccaaatgtgcgcttcaatgtggccaaaactttggcacgcgtgggaaaagttttggactcacanacactgaacagtgaggtnaaaccactnttggtcaagatgtgcgatgatccagaattcgatgtgcgttactttgccgaagaannnanannnnnnnnnnnnnnnnnn

SEQ ID NO: 189 - DNA, 6816 bp, Artificial Sequence
  Description of Artificial Sequence: Synthetic polynucleotide
  modified_base (1)..(66): a, c, t, g, unknown or other
  modified_base (228)..(228): a, c, t, g, unknown or other
  modified_base (648)..(648): a, c, t, g, unknown or other
  modified_base (951)..(951): a, c, t, g, unknown or other
  modified_base (966)..(966): a, c, t, g, unknown or other
  modified_base (1027)..(1027): a, c, t, g, unknown or other
  modified_base (1110)..(1110): a, c, t, g, unknown or other
  modified_base (1192)..(1266): a, c, t, g, unknown or other
  modified_base (1368)..(1368): a, c, t, g, unknown or other
  modified_base (1590)..(1590): a, c, t, g, unknown or other
  modified_base (1987)..(2103): a, c, t, g, unknown or other
  modified_base (2285)..(2287): a, c, t, g, unknown or other
  modified_base (2291)..(2293): a, c, t, g, unknown or other
  modified_base (2295)..(2295): a, c, t, g, unknown or other
  modified_base (2568)..(2568): a, c, t, g, unknown or other
  modified_base (2610)..(2610): a, c, t, g, unknown or other
  modified_base (2638)..(2638): a, c, t, g, unknown or other
  modified_base (2647)..(2647): a, c, t, g, unknown or other
  modified_base (2712)..(2712): a, c, t, g, unknown or other
  modified_base (2715)..(2715): a, c, t, g, unknown or other
  modified_base (2727)..(2727): a, c, t, g, unknown or other
  modified_base (2733)..(2733): a, c, t, g, unknown or other
  modified_base (2746)..(2750): a, c, t, g, unknown or other
  modified_base (2752)..(2758): a, c, t, g, unknown or other
  modified_base (2763)..(2764): a, c, t, g, unknown or other
  modified_base (2766)..(2767): a, c, t, g, unknown or other
  modified_base (2771)..(2771): a, c, t, g, unknown or other
  modified_base (2776)..(2776): a, c, t, g, unknown or other
  modified_base (2778)..(2778): a, c, t, g, unknown or other
  modified_base (3115)..(3246): a, c, t, g, unknown or other
  modified_base (3765)..(3765): a, c, t, g, unknown or other
  modified_base (4221)..(4221): a, c, t, g, unknown or other
  modified_base (4749)..(4749): a, c, t, g, unknown or other
  modified_base (4878)..(4878): a, c, t, g, unknown or other
  modified_base (5158)..(5364): a, c, t, g, unknown or other
  modified_base (5383)..(5385): a, c, t, g, unknown or other
  modified_base (5395)..(5396): a, c, t, g, unknown or other
  modified_base (5438)..(5439): a, c, t, g, unknown or other
  modified_base (5460)..(5460): a, c, t, g, unknown or other
  modified_base (5496)..(5496): a, c, t, g, unknown or other
  modified_base (5511)..(5511): a, c, t, g, unknown or other
  modified_base (5581)..(5673): a, c, t, g, unknown or other
  modified_base (5826)..(5826): a, c, t, g, unknown or other
  modified_base (6319)..(6558): a, c, t, g, unknown or other
  modified_base (6702)..(6702): a, c, t, g, unknown or other
  modified_base (6745)..(6816): a, c, t, g, unknown or other
nnnnnnnnnnnnnnnnnnnnnnnnnnnnnnnnnnnnnnnnnnnnnnnnnnnnnnnnnnnnnnnnnntccaggtataaaagaattttctccattggcaatttagcagttacaacttataatccgcaaactcttgaaatcacaaaccagtggttatatgaagattttttctcaattcgcattattagcgaacgtccaaagcattcaaatgctgattcaaacattaacttngaatttgctcgtgaagttgtcactgaaacacttcgttatcaaacccgttttgccaccgatcagaatgtgcagagaacggtttttaacttttacacaatatttataaacatttttttaaagaaatactcttgtcagaagcaaggatggtcagatcgacgaaatccggttacattggaagttgctgcttgttcactgaaccaactggatcacataaatactctttggaaaagttatgattataaagaaattcggatgatcacattgaagggacatcagcaaaatgcatttatcattgaattaggcgatcaacgaagacggcatcttttctattgtgacaaagctgaaaagctcataaaggaaatgcgcgaaaatgcacttgaatatctggcatttgatttgcaattgtcccgtgatccgctnaacttggacgatttctttctgactcggctaggactttgcagcaaagatgaacagttgacatcatatgcagaatttagagtgcaaaaaaggactaatcaaacagttggcgcagtgcgtcgtctgctttgcctaagcgaaatgtgcattatagaacgggatcccgtcagttacagcgtaatttgtgcccgtccattaaagacgatagtctgccttatacgcgatttaaaggacccacaaaaatttcaaattatttatgaaaatggtgatgaacgtgcatacacatcaaatgaatgggattctctncttgctgcactcatngatggagcgcgcggttcgggcaattatcaaattcatgttgtgtcaagacaacaacacaaanagcttcgtatggttccacttgggtttgcattggatgaggaaagcgagcaacaacttctcaaacacattgtccaaattcctctnggccttaaaagaattgatatgattcgccgttttaatgcaaacattccatacaatgggttgaacttttctgcgtccactgaannnnnnnnnnnnnnnnnnnnnnnnnnnnnnnnnnnnnnnnnnnnnnnnnnnnnnnnnnnnnnnnnnnnnnnnnnngatccgcacgagccggttaccagaatggaggcacaaatggcttgtctgcacagactatttgcttccaaaacgggatttcaagcattcactactgttgaaagnattcgcgaacggctcggtgctcttgtcgtagccgttctgaagcgcaaagaggaatcggttgatcatgcttgtgtggaaatgctaagcactttattacaaccaatgcatcccaattatgagctcagaatagagcagctcaataagcagtcattgttgtccagcagagcatttgttgagcatcttctgcagttggttgttgatcacgttgcgaaaggaacggtngcgcttgtaattgcatccatgctggacttcttgacatttacaatttgtgcgccatatagcgaaacaacgccgggtgatactttcgatgcaatgcttgagctagtggcacaaaaaggacgcacattttacaaactgtttcatcatccatcaatgacaattgtcaagggagccggcatggtgatgcgtgccatcattgaagaatcaacgcgggagattagtaaacaaatgcaattgatggcactaaccgaaggcgcatttcttaaacatttggaattggcacttttgagcacggggaaagacctgagagttctggcaaataagcaattaagcggatatttggtagcactctggattgctgaaagccaatcagccaaggatttactacaaagatgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaggatcagctcaaaagtatgcaaatcacactagaagcaagactggacacattattacaacactggaatttggaacaaaaattaaacttgcttcaaaatcatcgcgttaaagaagggcaacgagcccatcaacagcgaccagtgattcgaaagagacgacgacaagttaaggcaaccgnnnattnnnanttttacagttatcaatttgcccaaaatcacgctcgagccgatttgatttggaatgaaaaaacgcgcgatgaattccgacaggcaattgacaatgaaatgcgcatattgcaacaggaactggagtttatacaacctggcactgcagtggcctggaatcacgcggaatttgcgataacctataattctttggccgatgagatcaggattggtgattattatttacgttttcttttgactgaagagaatgatacagcaacacctattcataagccncaggaatttttcaacaacatttaccaccgattcctactcacncaaaagaatgaaatgcgatgcatttgtntgcgtgcantggcaattgtctatgaaaggcattgtatcagtattggcccatttgctgacacacggcacattgtncanatgttggcaaantgtacnaacttggccgaannnnncnnnnnnnttttnntnntcancaagntngcacttgataagcaaaatgtccgagaactaatcacagccgatgcactaccattacttattgacattgccgtgctggcccatttgcacataaaccgtgccaaattgcacggccaaaccaatgtaattgaagcggcaaagggatcaacagaagaaaatgaacccaaggaatggtattacaatgataaacaaggacaacggcaaggacccatttctttcaaaaaaatgaagcaattctatcgcgaaggtgttctttttgagaagagtgaagtttgggccgaaggattggacaaatggtgtcacctctcatccgttgcacaatttcgatggacaatctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgatactggcgctgtgattcgtccacttccaaaagtgaagaaaatactttcggaaccagttctcctctatcaattggttcaacttctaatcacatacgatccttccattgtacaaagagttgccacgctagtcaatgcaattatgcaggataacccgtcagtgccgaggctatacctttctggtgtattcttcttcattctcatgtacaatggctcgaacattttgccagtagcccgattcttgaaggacacccatttaaagcaggcttttcgctcgacactgagtaaatccgaactggcttctcgttctgtgctttgtccaatgctgccggaagcaaacattttttatttggagcaatacggcgccgagaaatatgccgaagtttttctcggagaatttgaaaatcctgagtgcatttggaatagcgaaatgcggagacatatgatcgagaaagtggcaattcatgttgccgatttctcatgtcgtctttcatccaatgtcaaagctttatatagntattgcccaattccgcccatagaatatccccaactgaaagaagagcttttctgccatttttactatcttcgtcatttaacagaccagcaacgctttccacgatggcctatcagagaaccggtggaatttttgcgtgcttgcctttctgcatggcatgatgaaattacgcgaaagccagcaaaaatgtccgtagaagaggcttgcgaacgtcttgggctttcgacaacggataagtcgagccaagatccaacccaagtacggcgagcttatttcaaactggcgcaaaaatatcacccggataaaaaccctgacggacgcgaacaatttgagcaaataaattatgcttatgaatttcttacttcaactcgcgccaattcctctcaggatccggatattaaccgaattgttatcatcctcaaagcacaaagcattgtgtacagccggaatttggaagtnctttctccgtacaaatatgcgggctatacgcaactcataaagacaatcgacctggaatctaccgacgaaacattattctcaagaagcggaggtcgattgcttattgctgctgtggagctctgctattggacattgagaagttcccctttgaatgctgaacaattgcggcgtgatggtggacttgatgctctttataaaacctttgagcggtgtgtgccgatgattacccaaagttcacaggaaatggatatgcccgtacaagtttgcattcatgtttgcaattgctttggcacagctgcacgttttgaagcttcccgcgaaaaaatttctgaaatgaaagcaatttttaaaagtatttgccaactgcttcgatttgagcacctaaatcgacttgcttgtgccgcagcagattgcatttgcaatttatcggtttgcacactgctccaaactcaactcttccaagcgggtgttatttggcaattgttgcctcatttatttcgatttgattggactttggatgaaggagtngtcacccattccgagaaaaccaaccagcaggcagttttgaatcgactggctagaagttgctgtgaagcattggcttgtcttgctggatatcgcccagaaactcccgataacgatggagttcaaaacagncttcgcgccatgttaacaccatatatttgccgtcaaatgcaacgggcttcaatggacatcgtactcaagttattgaattccaacactgaggacccatatttgatttggaataatgctacacgtgcagaactgttagactttgttgaacggcaccgaaattccaatgaaaatttgagtgaattatttggcgcagaattcaagttaagcgtctttgcttctgaattagtcgtgggcgatatttttattcgcatttacaattctcagcccgaatttaagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaaggtattgaattgnnnttgattggcnncttcaagactttattcggctttctccgtatccattcactgcnngcaattcaattgaaaacactncaaatcatctccattgcagccagcaataaggaatgngtcagtgacatttcngattcaatccaactttctctattgctcattttgctgatacaattgccaaaaggtttatctgatttaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggatccgcttcagcaagcagaatgttggcggccgaattacttgctaaattacaagcggacaagttgactggacccaaatggactcgatttttggttcgatttctgcctagcatttttgcggactcacttcgagataatcctggcatgacnatccaaatgttcgacaataacacggagaatcccgagttaatttggaatgatgatatgcgaaatggtgttcgtcaaatcctgcgcaaaatccttgccgaacttttgcaagcacaacaatccgatccaaaagcaaaatggaatacgtcggtcattggcgagaaccaatgcgcgtatgagagtgttttaagcggtgaaatcattattggcggcgtatatcttcggcttttcattggcaatccttcctggacggttcgccatccacgccaatttgcaactgaatttatggagaaattgctagaagagcaacagcaatggaaaagccatcttgagcaagttacaaaaggctttgtactattggctgctcaccatccaacgaccattgatatgattccggcacagggttacctgcctcaattttgccaagcaatgcaaatagctagctcgagtgttgcacgttcggctgtgctcattctaaatcaactcacagaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgccctgaaaatgttttgtcgcgaggcccaatttggtgagcgcatttccgcgttcctccagcgctctcctgtttgggcacaatacaaagaccaacgacatgatctctttttgcccacaacacaaacgcaagcaattacagcnggatctgcctcgattgcgggatatttgacagaaggaatgttcnnnnnnnnnnnnnnnnnnnnnnnnnnnnnnnnnnnnnnnnnnnnnnnnnnnnnnnnnnnnnnnnnnnnnnnn

SEQ ID NO: 190 - DNA, 261 bp, Artificial Sequence
  Description of Artificial Sequence: Synthetic polynucleotide
  modified_base (1)..(12): a, c, t, g, unknown or other
  modified_base (31)..(36): a, c, t, g, unknown or other
  modified_base (96)..(96): a, c, t, g, unknown or other
  modified_base (129)..(129): a, c, t, g, unknown or other
  modified_base (192)..(192): a, c, t, g, unknown or other
  modified_base (198)..(198): a, c, t, g, unknown or other
  modified_base (238)..(261): a, c, t, g, unknown or other
nnnnnnnnnnnnataccatttattattatgnnnnnnttttgggcagtgattggtgcgggcggaccattcctagttccaagtggagtgaacaaaganatcattcaaacaatgatagtgatgacggccgtntgctgttacatgttctggctaattgtctacctgcatcaactcaacccattgattggtccacanctcccngtcaagaccattttctggattcatgagaagtggggcgatnnnnnnnnnnnnnnnnnnnnnnnn

SEQ ID NO: 191 - DNA, 1281 bp, Artificial Sequence
  Description of Artificial Sequence: Synthetic polynucleotide
  modified_base (1)..(42): a, c, t, g, unknown or other
  modified_base (199)..(1050): a, c, t, g, unknown or other
  modified_base (1182)..(1182): a, c, t, g, unknown or other
  modified_base (1185)..(1185): a, c, t, g, unknown or other
  modified_base (1192)..(1192): a, c, t, g, unknown or other
  modified_base (1197)..(1197): a, c, t, g, unknown or other
  modified_base (1203)..(1203): a, c, t, g, unknown or other
  modified_base (1224)..(1225): a, c, t, g, unknown or other
  modified_base (1227)..(1227): a, c, t, g, unknown or other
  modified_base (1236)..(1236): a, c, t, g, unknown or other
  modified_base (1239)..(1239): a, c, t, g, unknown or other
  modified_base (1243)..(1243): a, c, t, g, unknown or other
  modified_base (1249)..(1251): a, c, t, g, unknown or other
  modified_base (1263)..(1267): a, c, t, g, unknown or other
  modified_base (1269)..(1269): a, c, t, g, unknown or other
  modified_base (1272)..(1273): a, c, t, g, unknown or other
  modified_base (1275)..(1281): a, c, t, g, unknown or other
nnnnnnnnnnnnnnnnnnnnnnnnnnnnnnnnnnnnnnnnnngtgatcatgtcgcgcaactaccgaggcgacatcgacgtcggttgcattgaaaagttcatgccgctgctgatggagcaggaggacgagggccgaacatcgccaatcattcagaagggcgaacacagttacatctacatcaagcacatgaacatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcaggaggccgtgagtacttgatgcgcgcccatttcagcctaccctcggtggaaggcgaagaattggactcaaaacggccaatcagtgtgaagttcgaaatcccctatttcaccacctctggattgcangtncgctacntgaanatcatngagaagagcggctaccaagcnntnccctgggtncgntacntcaccnnnaatggcgactannnnntncgnntnnnnnnn

SEQ ID NO: 192 - DNA, 1464 bp, Artificial Sequence
  Description of Artificial Sequence: Synthetic polynucleotide
  modified_base (117)..(117): a, c, t, g, unknown or other
  modified_base (903)..(903): a, c, t, g, unknown or other
  modified_base (1225)..(1464): a, c, t, g, unknown or other
atgttggtactttttgaaactgctgctggatatgctttgtttaagctaactgatgaaagtttgttacaaagagttgacaacatttggaaagaatttgaaagcggacaaaatccaagnatcagtttggaactcgtctccttcaaacgttacaagtctattgccgaagcagttaataatgcaaccgaaatttcggaaggaaaattgaacaaatcactcaagcgattgttgaagaagaatgtggatcaaggcgagaaactggcagtcgaagacaccaatttgggaaagctcatcaagagcacacttgagatcaaatgtcttcacaacacggcggtctcggaattgatgcgttcaattcgcgcaaatgttgagaaactggttaatgatgaggaccaacaaattaacgcaatgcgattgggggtggcgcatgctgttggtcgctacaaagtcaagttcaacccggagaagattgacacaatgattgtgcaagctgtttccttgttggatgatcttgataaagagctgaacaactatgtgatgcgttgccgcgaatggtacggttggcattttcctgaacttggcaaactgatcactgatccacaggcctatgcaaagtgtgtcaaagcaatcgggatgaagccaaatgctcagacagcaaaactcgagacaattctacccgagaatttggtggagcaagttcgcgcagaggccgagatcagcatgggtacggatatcactgagctggatcttattcacatccgagagctttgtgatcaaatcattgagcttggtcaatatcgtgcacaattgcatgaatacttaaagaaccgaatgaatgccttggctccgaatttgaccgttctgcttggtgaattgattggcgcaaggctgatttcgaaagcagtntctctgatggcattggccaaatgtcctgcttcaacggtacaaattttgggagcggagaaggcacttttccgtgcactgaagaccaagaaggacacacctaaatatggaatcatttaccatgctcaactggtcacacaagcaggacaaaaggcaaaaggaaagattgcacgaaaacttgctgcgaaaattgcgctggcaactcgcgtagacgccctctgcgatgaatcactgggtaatcaacagggcttggatgcccgcatctacctggaacaagctataaaggaagaaaatgcacgaagtgggatcaagaaacagcgttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 193 - DNA, 6504 bp, Artificial Sequence
  Description of Artificial Sequence: Synthetic polynucleotide
  modified_base (1)..(264): a, c, t, g, unknown or other
  modified_base (619)..(619): a, c, t, g, unknown or other
  modified_base (621)..(621): a, c, t, g, unknown or other
  modified_base (713)..(713): a, c, t, g, unknown or other
  modified_base (795)..(795): a, c, t, g, unknown or other
  modified_base (906)..(906): a, c, t, g, unknown or other
  modified_base (1212)..(1212): a, c, t, g, unknown or other
  modified_base (1291)..(1293): a, c, t, g, unknown or other
  modified_base (1524)..(1524): a, c, t, g, unknown or other
  modified_base (2109)..(2109): a, c, t, g, unknown or other
  modified_base (2113)..(2113): a, c, t, g, unknown or other
  modified_base (2116)..(2116): a, c, t, g, unknown or other
  modified_base (2143)..(2143): a, c, t, g, unknown or other
  modified_base (2145)..(2145): a, c, t, g, unknown or other
  modified_base (2148)..(2148): a, c, t, g, unknown or other
  modified_base (2152)..(2152): a, c, t, g, unknown or other
  modified_base (2166)..(2167): a, c, t, g, unknown or other
  modified_base (2182)..(2182): a, c, t, g, unknown or other
  modified_base (2184)..(2184): a, c, t, g, unknown or other
  modified_base (2186)..(2187): a, c, t, g, unknown or other
  modified_base (2191)..(2191): a, c, t, g, unknown or other
  modified_base (2194)..(2196): a, c, t, g, unknown or other
  modified_base (2201)..(2202): a, c, t, g, unknown or other
  modified_base (2204)..(2205): a, c, t, g, unknown or other
  modified_base (2215)..(2215): a, c, t, g, unknown or other
  modified_base (2221)..(2221): a, c, t, g, unknown or other
  modified_base (2223)..(2223): a, c, t, g, unknown or other
  modified_base (2225)..(2225): a, c, t, g, unknown or other
  modified_base (2230)..(2231): a, c, t, g, unknown or other
  modified_base (2238)..(2238): a, c, t, g, unknown or other
  modified_base (2241)..(2241): a, c, t, g, unknown or other
  modified_base (2245)..(2245): a, c, t, g, unknown or other
  modified_base (2265)..(2265): a, c, t, g, unknown or other
  modified_base (2281)..(2484): a, c, t, g, unknown or other
  modified_base (2548)..(2550): a, c, t, g, unknown or other
  modified_base (2563)..(2567): a, c, t, g, unknown or other
  modified_base (2569)..(2571): a, c, t, g, unknown or other
  modified_base (2573)..(2578): a, c, t, g, unknown or other
  modified_base (2580)..(2580): a, c, t, g, unknown or other
  modified_base (2583)..(2583): a, c, t, g, unknown or other
  modified_base (2586)..(2586): a, c, t, g, unknown or other
  modified_base (2593)..(2593): a, c, t, g, unknown or other
  modified_base (2595)..(2595): a, c, t, g, unknown or other
  modified_base (2598)..(2603): a, c, t, g, unknown or other
  modified_base (2607)..(2610): a, c, t, g, unknown or other
  modified_base (2613)..(2616): a, c, t, g, unknown or other
  modified_base (2619)..(2619): a, c, t, g, unknown or other
  modified_base (2622)..(2623): a, c, t, g, unknown or other
  modified_base (2626)..(2628): a, c, t, g, unknown or other
  modified_base (2631)..(2631): a, c, t, g, unknown or other
  modified_base (2638)..(2642): a, c, t, g, unknown or other
  modified_base (2644)..(2644): a, c, t, g, unknown or other
  modified_base (2647)..(2649): a, c, t, g, unknown or other
  modified_base (2653)..(2655): a, c, t, g, unknown or other
  modified_base (2658)..(2659): a, c, t, g, unknown or other
  modified_base (2662)..(2662): a, c, t, g, unknown or other
  modified_base (2677)..(2677): a, c, t, g, unknown or other
  modified_base (2686)..(2687): a, c, t, g, unknown or other
  modified_base (2692)..(2692): a, c, t, g, unknown or other
  modified_base (2697)..(2700): a, c, t, g, unknown or other
  modified_base (2706)..(2706): a, c, t, g, unknown or other
  modified_base (2723)..(2723): a, c, t, g, unknown or other
  modified_base (2725)..(2725): a, c, t, g, unknown or other
  modified_base (2727)..(2728): a, c, t, g, unknown or other
  modified_base (2735)..(2737): a, c, t, g, unknown or other
  modified_base (2745)..(2745): a, c, t, g, unknown or other
  modified_base (2747)..(2748): a, c, t, g, unknown or other
  modified_base (2752)..(2752): a, c, t, g, unknown or other
  modified_base (2767)..(2767): a, c, t, g, unknown or other
  modified_base (2782)..(2782): a, c, t, g, unknown or other
  modified_base (2787)..(2787): a, c, t, g, unknown or other
  modified_base (2796)..(2796): a, c, t, g, unknown or other
  modified_base (2801)..(2801): a, c, t, g, unknown or other
  modified_base (2816)..(2816): a, c, t, g, unknown or other
  modified_base (2820)..(2820): a, c, t, g, unknown or other
  modified_base (2823)..(2823): a, c, t, g, unknown or other
  modified_base (2826)..(2826): a, c, t, g, unknown or other
  modified_base (2830)..(2830): a, c, t, g, unknown or other
  modified_base (2844)..(2844): a, c, t, g, unknown or other
  modified_base (2854)..(2854): a, c, t, g, unknown or other
  modified_base (2863)..(2863): a, c, t, g, unknown or other
  modified_base (2880)..(2880): a, c, t, g, unknown or other
  modified_base (2889)..(2889): a, c, t, g, unknown or other
  modified_base (2895)..(2895): a, c, t, g, unknown or other
  modified_base (2905)..(2905): a, c, t, g, unknown or other
  modified_base (2908)..(2908): a, c, t, g, unknown or other
  modified_base (2916)..(2916): a, c, t, g, unknown or other
  modified_base (2929)..(2929): a, c, t, g, unknown or other
  modified_base (2933)..(2933): a, c, t, g, unknown or other
  modified_base (2937)..(2940): a, c, t, g, unknown or other
  modified_base (2943)..(2943): a, c, t, g, unknown or other
  modified_base (2949)..(2949): a, c, t, g, unknown or other
  modified_base (2958)..(2958): a, c, t, g, unknown or other
  modified_base (2968)..(2968): a, c, t, g, unknown or other
  modified_base (2973)..(2973): a, c, t, g, unknown or other
  modified_base (2981)..(2983): a, c, t, g, unknown or other
  modified_base (2997)..(2997): a, c, t, g, unknown or other
  modified_base (3013)..(3013): a, c, t, g, unknown or other
  modified_base (3019)..(3021): a, c, t, g, unknown or other
  modified_base (3024)..(3026): a, c, t, g, unknown or other
  modified_base (3038)..(3038): a, c, t, g, unknown or other
  modified_base (3045)..(3045): a, c, t, g, unknown or other
  modified_base (3051)..(3051): a, c, t, g, unknown or other
  modified_base (3101)..(3101): a, c, t, g, unknown or other
  modified_base (3114)..(3114): a, c, t, g, unknown or other
  modified_base (3125)..(3125): a, c, t, g, unknown or other
  modified_base (3136)..(3137): a, c, t, g, unknown or other
  modified_base (3139)..(3139): a, c, t, g, unknown or other
  modified_base (3147)..(3147): a, c, t, g, unknown or other
  modified_base (3173)..(3173): a, c, t, g, unknown or other
  modified_base (3177)..(3177): a, c, t, g, unknown or other
  modified_base (3186)..(3186): a, c, t, g, unknown or other
  modified_base (3189)..(3189): a, c, t, g, unknown or other
  modified_base (3205)..(3206): a, c, t, g, unknown or other
  modified_base (3209)..(3209): a, c, t, g, unknown or other
  modified_base (3212)..(3212): a, c, t, g, unknown or other
  modified_base (3214)..(3214): a, c, t, g, unknown or other
  modified_base (3216)..(3216): a, c, t, g, unknown or other
  modified_base (3219)..(3219): a, c, t, g, unknown or other
  modified_base (3261)..(3261): a, c, t, g, unknown or other
  modified_base (3321)..(3321): a, c, t, g, unknown or other
  modified_base (3601)..(3810): a, c, t, g, unknown or other
  modified_base (3894)..(3894): a, c, t, g, unknown or other
  modified_base (3964)..(4107): a, c, t, g, unknown or other
  modified_base (4173)..(4173): a, c, t, g, unknown or other
  modified_base (4450)..(4452): a, c, t, g, unknown or other
  modified_base (4456)..(4456): a, c, t, g, unknown or other
  modified_base (4459)..(4464): a, c, t, g, unknown or other
  modified_base (4466)..(4467): a, c, t, g, unknown or other
  modified_base (4470)..(4474): a, c, t, g, unknown or other
  modified_base (4476)..(4482): a, c, t, g, unknown or other
  modified_base (4484)..(4485): a, c, t, g, unknown or other
  modified_base (4487)..(4487): a, c, t, g, unknown or other
  modified_base (4491)..(4491): a, c, t, g, unknown or other
  modified_base (4493)..(4502): a, c, t, g, unknown or other
  modified_base (4505)..(4509): a, c, t, g, unknown or other
  modified_base (4513)..(4516): a, c, t, g, unknown or other
  modified_base (4521)..(4521): a, c, t, g, unknown or other
  modified_base (4524)..(4524): a, c, t, g, unknown or other
  modified_base (4529)..(4530): a, c, t, g, unknown or other
  modified_base (4533)..(4533): a, c, t, g, unknown or other
  modified_base (4536)..(4536): a, c, t, g, unknown or other
  modified_base (4542)..(4549): a, c, t, g, unknown or other
  modified_base (4553)..(4554): a, c, t, g, unknown or other
  modified_base (4557)..(4557): a, c, t, g, unknown or other
  modified_base (4559)..(4559): a, c, t, g, unknown or other
  modified_base (4565)..(4565): a, c, t, g, unknown or other
  modified_base (4569)..(4571): a, c, t, g, unknown or other
  modified_base (4574)..(4574): a, c, t, g, unknown or other
  modified_base (4576)..(4577): a, c, t, g, unknown or other
  modified_base (4581)..(4581): a, c, t, g, unknown or other
  modified_base (4588)..(4589): a, c, t, g, unknown or other
  modified_base (4591)..(4591): a, c, t, g, unknown or other
  modified_base (4593)..(4593): a, c, t, g, unknown or other
  modified_base (4597)..(4600): a, c, t, g, unknown or other
  modified_base (4603)..(4605): a, c, t, g, unknown or other
  modified_base (4608)..(4608): a, c, t, g, unknown or other
  modified_base (4617)..(4617): a, c, t, g, unknown or other
  modified_base (4654)..(5163): a, c, t, g, unknown or other
  modified_base (5371)..(5382): a, c, t, g, unknown or other
  modified_base (5385)..(5388): a, c, t, g, unknown or other
  modified_base (5395)..(5395): a, c, t, g, unknown or other
  modified_base (5397)..(5400): a, c, t, g, unknown or other
  modified_base (5403)..(5404): a, c, t, g, unknown or other
  modified_base (5406)..(5409): a, c, t, g, unknown or other
  modified_base (5411)..(5413): a, c, t, g, unknown or other
  modified_base (5415)..(5415): a, c, t, g, unknown or other
  modified_base (5419)..(5419): a, c, t, g, unknown or other
  modified_base (5421)..(5421): a, c, t, g, unknown or other
  modified_base (5427)..(5436): a, c, t, g, unknown or other
  modified_base (5439)..(5439): a, c, t, g, unknown or other
  modified_base (5441)..(5442): a, c, t, g, unknown or other
  modified_base (5446)..(5451): a, c, t, g, unknown or other
  modified_base (5455)..(5456): a, c, t, g, unknown or other
  modified_base (5459)..(5463): a, c, t, g, unknown or other
  modified_base (5466)..(5466): a, c, t, g, unknown or other
  modified_base (5479)..(5479): a, c, t, g, unknown or other
  modified_base (5481)..(5481): a, c, t, g, unknown or other
  modified_base (5484)..(5484): a, c, t, g, unknown or other
  modified_base (5487)..(5487): a, c, t, g, unknown or other
  modified_base (5489)..(5489): a, c, t, g, unknown or other
  modified_base (5491)..(5494): a, c, t, g, unknown or other
  modified_base (5497)..(5497): a, c, t, g, unknown or other
  modified_base (5500)..(5500): a, c, t, g, unknown or other
  modified_base (5502)..(5502): a, c, t, g, unknown or other
  modified_base (5505)..(5505): a, c, t, g, unknown or other
  modified_base (5510)..(5513): a, c, t, g, unknown or other
  modified_base (5516)..(5516): a, c, t, g, unknown or other
  modified_base (5640)..(5640): a, c, t, g, unknown or other
  modified_base (5669)..(5670): a, c, t, g, unknown or other
  modified_base (5673)..(5673): a, c, t, g, unknown or other
  modified_base (5681)..(5684): a, c, t, g, unknown or other
  modified_base (5688)..(5688): a, c, t, g, unknown or other
  modified_base (5691)..(5692): a, c, t, g, unknown or other
  modified_base (5694)..(5694): a, c, t, g, unknown or other
  modified_base (5700)..(5702): a, c, t, g, unknown or other
  modified_base (5704)..(5706): a, c, t, g, unknown or other
  modified_base (5838)..(5838): a, c, t, g, unknown or other
  modified_base (5905)..(6504): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcgttcttgcggtggcggagtgctcgtggaaaggcgcacctgctccggccaatgcacgggcccgaccatccgttacgtgtcctgcaatgtggagccatgcccggcggccagggacttccgctcggagcaatgctcggcacacaacgatgacgcattggacggcaattactacaagtgggtgccatacgcagggaagaacaaatgcgagttgacttgccggccagaggattccagcttttactacaaattcgccgagaaagttgtggatggcacgcgctgtgatccttacggggaggacatttgcgtggacggcatttgcctaccggttggatgcgacggcaaacttggctcantngccaagaaggacaagtgcggcgtttgcaacggggacgggtcggaatgcaaaacggtggagggacttttcgatgagcgggcactgtccacagnttatcacgacatcatcgcattgccagttggggccactgccattttggtggaagagttgcggccaaccagcaatgtttttganattaaaaacggcactggccatttcctgctgaatggcaactaccaaatccaagtggacaagaacatcatggccggcggcactgccttccgatacgagaagggcgaaactganaagttgacagccaatgggcccttgcaagagccaatcacaatcgccctcctcctgcagagggcggcgaaaaacagtgccgtcaaatacgagttctcggtgcccctggagaaggatgtgaaattcctgtggaaacccggcgaatggtcgggctgttcggtcagttgcggcaaaggcattcgcaccagaacgctttattgcacggacatggccagccaaagtcgggtggaggatgccgtctgcgaagagcaaaacgcgacaaagcccgagttcgagagggaatgcaaacagtggactgcgagcctgagntggtttgttggcgattgggaacagtgttcggcaagttgtggcgacaaaggcatccagctgcgagtggtttactgccatnnngtgttcgcggacggccggcggatgacagtgccggacgggaactgcacgttggaaaggcccgagctgagccagtcctgctcccgctggtcatgtccggaatggcaagcagggccatggtcggcctgctcttcccagtgcggcgatgccaaacagttccggtcggtcacgtgccgaagtgccaaggagggcgaggaggggaagttgctggctgcgcaggcgtgcggtgaacgngatcaggaagtgccgggcgccgaaagggactgcaaccttgggccgtgcgaaggccttcggttccacactaccgactgggaattgtgccaacgctgcaacgacacggaggagcgtaggaaagtgacttgccgggacaagaacggccgtgagtatccgctggagaagtgcctggacgagaagggcgatggcgagaagaaggattcccgatgatgtgcggcgccaccgccctgcatttacgaatggcacacctcccagtggtcgaagtgcagcacggaatgtgggcacgggcacaagagtcgcaaggtgttttgtgccatcaacgagcagggacaaaccaagcgaatcgacgaatccctttgctccggcgaaaggcccgaggagcgcgaggagtgcgtcaacgaggagaagtgcacgggcacattcttcactggcccatggtcggaatgctcggcccagtgcgcgggtggcaagcagaatcgctcggtggtttgcctcaactacgaccgaaagccggtgccggaatggtgcgacgagaaggagaaaccggtggaggagcaggaatgcaacacagagccttgtcctacntgcnccnacaccaagttcggctgctgccccgacnangtnaccnccgcccggggcccnnacctcgagggctgcncnanntgcncgnnntcgcnntnnggctgttgcnaggacngngngacanncgcactnggncccnagggcgagggctgcgacgantttgtgccgccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtttggctgctgctcggattggtacacacccgcggaagggccaaaccaggcgggatgccccnnnttcgtcctcggcnnnnncnnngnnnnnnanttnggntgctgcncngannnnnncacnnnngcnnnnggnccnnacnnngcnggatgcnnnnngnccnnntgcnnngcnncgnagttcggctgctgcncggaccganncacantcgcnnnnggcccnaactatgcgggatgcgncnannccagttnnncctgcgangnntccnagtacggctgctgcncggaccgagtcacgntcgcnttgggcccnaattntgcgggctgcggagngagntgngangtgnccaagtacggctgntgcccggacngagtcacgntcgcattgggcccaaantatgcgggntgcggntgcgaggacnccnagtacggntgctgcccggacngagncacnnnngcnaagggnccaaactangcgggatgcnccganagttgcgnnnacaccaagtacggntgctgcccggacggantcaccnnngcnnngggcccaaactncgagggntgcccntgcgactactcccagtacggctgctgcccggacggcgtcaccgccgcccngggccccaattgngagggctgcgnaagttgcgcgnngnccaagtanggctgttgcccggacggtgtcacgancgcnctgggcccnaanggcgagggctgcccgnncancangncnccnccctacatccttggtggaaccgtgtcgccatccagcattgcntcttgctcacagccccaggaccagggccaagtgtgcgcacccggctataaacttgtttgnttcttcgacatgcaagagagtcggtgctcgcaattctggtacggcggatgcggcggaaatgataatcggtttggtagcaaggaacaatgcgaacagacttgtgttgagcccccgggcattgggcgctgctatttgcccaaggtggaggggcccaagcgttgcaaccaattggccgcccgctactactacgactacctcagcaagcagtgcacggcattctggcaccaggggtgccttggcaatgccaacaactttggctcctgggaagagtgccaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacgatgccagtggatgccggaccgtgtgaggattttgtcacaatgtggtatttcgattctggcttgcaacagtgccgaagnttcacttttggtggctgccgcggcaaccccaaccggtttgtgtccaaagaggattgcgagatgcaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggacgacccgtgccgtttgactgtggacagtggcaattgccagagttaccaggaccagtgntactacgaagttgccaccggccaatgcgaacgcttcacctattccggctgcggaggcaatgcgaaccggttcaacagcagggaggattgccaggcactctgttcgggcgatgccgctgccgcactgttgggcgacctttccaacacggcacggttggcagcaatttgtgaagcgccaaaggacacggggtcgtgcaagaactttgccaccaaatggtactacaacaagttggacggcacttgcaatcgtttccattttggcggttggttgaatggcnnnaatnggnnnnnnannaannnnnannnnnnncnnanttgngnnnnnnnnnnggnnnnntgcnnnntgccnaangtggnnggnccntgcaannnnnnnnccgnncgntnctactncgannnccncnncaancagtgcnngncnttcnnnnacnnnggntgccttggnaatgccaacaactttggctcctgggaagagtgccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccaaacattaacaattcaagaactctgcctgttaccagaagagcgtggaaattgctttggcgaaatcctccgctttcgctatgatcccgactcggatgactgtgttggattcctctacactggatgcggccaaaatgcaaatgcctttctctcctacgagtcttgcgcgagggcctgtggccgatggaaaaatgaggcgatttgcnnnnnnnnnnnngannnnggcaatngnnnnagnnannnngnnnantggnanttcgannnnnnnnnnggnanntgcnnnnnnttcnnctnnnnnggntgcggtggcaacngnaancgntncnnnngtnagncngantgcgnnnntcnctgccatcgtgagattcagattcgtgcccatcgtgagccatgcacgatgccagtggatgccggaccgtgtgaggattttgtcacaatgtggtatttcgattctggcttgcaacagtgccgaagnttcacttttggtggctgccgcggcaaccnnaancggtttgnnnncaangannantgcgannngnnntgtgttgagcccccgggcattgggcgctgctatttgcccaaggtggaggggcccaagcgttgcaaccaattggccgcccgctactactacgactacctcagcaagcagtgcacggcattctggcaccagggntgcgaaggcaatgcaaaccggtttgacacggaacaacaatgcaaaaacacttgcggcgaataccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 194 - DNA, 1596 bp, Artificial Sequence
  Description of Artificial Sequence: Synthetic polynucleotide
  modified_base (1)..(21): a, c, t, g, unknown or other
  modified_base (369)..(369): a, c, t, g, unknown or other
  modified_base (514)..(540): a, c, t, g, unknown or other
  modified_base (757)..(885): a, c, t, g, unknown or other
  modified_base (1006)..(1035): a, c, t, g, unknown or other
  modified_base (1119)..(1119): a, c, t, g, unknown or other
  modified_base (1279)..(1596): a, c, t, g, unknown or other
nnnnnnnnnnnnnnnnnnnnncagtacactcgcggcacagctcgagttttcatttcccggaagaaggcggtgaagaagctgcagctcagcctgaaggattttcgacgactttgcattctgaaggggatttacccacgggagcccaacaaaatcaagaaagcaaacaagggaagtacgcagaacaagattttctaccatctccgcgacatcaacttccttgcccaagagccgctgcttcaaaagtttcgggaatacaaggttttcctgcgcaaagtgagccatgcacgggcaaagaagaacaacgagcaagtgaacagcctgctacagcgcaaaccccggtttacctatgaccacattgtgaaagaaagntacccaaccttctcgtctgcccttcgcgacctggacgacgccctctgtctgtgctttgcattcgccaacctggcccagtccaaagtggccccgcatggactcattgagagaagcaagcggctggtcaccgagttcatgcattttnnnnnnnnnnnnnnnnnnnnnnnnnnngtgttcatttccatcaagggcatctactaccaggccgaagtgatgggcgaacgcgtcacctggctggtcggccacgagcgaggggtgggacgggcgaatgagctggactttacgacaatgaccaactttgtggagttctacacgtgcatgctggccttcgtgaactaccggctgttcaagtccatcgggctgttctatccgcccctgttgcagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgggacggacattgcggagaagttgcgccgggcggaggccctcaagtccctctttgccgaattcaagttcttcctcaaccgagaagtgcccaaggagccgctggcttttgtcatccggnnnnnnnnnnnnnnnnnnnnnnnnnnnnnngccccgggcggcatcaccgaggccagcgagctgatcacccaccaggttgtggaccggccaatgcagaagatggacttgaacggngtgtacatccagccccaatgggtgtttgactgcttcaacgggcggcgcctgctaccggccgtcaggtacgcgcccgcggccaccctgccgccccatctttcgccattcgttgacgaacacgccgtcgatcaaatcccagtggagcgattggaggctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 195 - DNA, 4203 bp, Artificial Sequence
  Description of Artificial Sequence: Synthetic polynucleotide
  modified_base (1)..(45): a, c, t, g, unknown or other
  modified_base (429)..(429): a, c, t, g, unknown or other
  modified_base (495)..(495): a, c, t, g, unknown or other
  modified_base (498)..(498): a, c, t, g, unknown or other
  modified_base (537)..(537): a, c, t, g, unknown or other
  modified_base (549)..(549): a, c, t, g, unknown or other
  modified_base (564)..(564): a, c, t, g, unknown or other
  modified_base (570)..(570): a, c, t, g, unknown or other
  modified_base (585)..(585): a, c, t, g, unknown or other
  modified_base (633)..(633): a, c, t, g, unknown or other
  modified_base (1227)..(1227): a, c, t, g, unknown or other
  modified_base (1278)..(1278): a, c, t, g, unknown or other
  modified_base (1449)..(1449): a, c, t, g, unknown or other
  modified_base (1455)..(1455): a, c, t, g, unknown or other
  modified_base (1491)..(1491): a, c, t, g, unknown or other
  modified_base (1554)..(1554): a, c, t, g, unknown or other
  modified_base (1560)..(1560): a, c, t, g, unknown or other
  modified_base (1578)..(1578): a, c, t, g, unknown or other
  modified_base (1587)..(1587): a, c, t, g, unknown or other
  modified_base (1617)..(1617): a, c, t, g, unknown or other
  modified_base (1620)..(1620): a, c, t, g, unknown or other
  modified_base (1659)..(1659): a, c, t, g, unknown or other
  modified_base (1680)..(1680): a, c, t, g, unknown or other
  modified_base (1750)..(1965): a, c, t, g, unknown or other
  modified_base (2085)..(2085): a, c, t, g, unknown or other
  modified_base (2304)..(2304): a, c, t, g, unknown or other
  modified_base (2691)..(2691): a, c, t, g, unknown or other
  modified_base (2715)..(2715): a, c, t, g, unknown or other
  modified_base (2760)..(2760): a, c, t, g, unknown or other
  modified_base (2788)..(3033): a, c, t, g, unknown or other
  modified_base (3118)..(3118): a, c, t, g, unknown or other
  modified_base (3120)..(3120): a, c, t, g, unknown or other
  modified_base (3123)..(3123): a, c, t, g, unknown or other
  modified_base (3252)..(3252): a, c, t, g, unknown or other
  modified_base (3303)..(3303): a, c, t, g, unknown or other
  modified_base (3402)..(3402): a, c, t, g, unknown or other
  modified_base (3442)..(3442): a, c, t, g, unknown or other
  modified_base (3489)..(3489): a, c, t, g, unknown or other
  modified_base (3514)..(3636): a, c, t, g, unknown or other
  modified_base (3783)..(3783): a, c, t, g, unknown or other
  modified_base (3828)..(3828): a, c, t, g, unknown or other
  modified_base (3897)..(3897): a, c, t, g, unknown or other
  modified_base (3933)..(3933): a, c, t, g, unknown or other
  modified_base (4035)..(4035): a, c, t, g, unknown or other
  modified_base (4125)..(4125): a, c, t, g, unknown or other
  modified_base (4174)..(4203): a, c, t, g, unknown or other
nnnnnnnnnnnnnnnnnnnnnnnnnnnnnnnnnnnnnnnnnnnnnactggagtcaaatttacggccggcagtacagagttgatccggcaagcggcccacacacaaatttgcaataatcggctctacgaggaagtacagggcaaatggcaaccggcaaaatatggaccgttggatgctcgactaggcactgtccaaaagtcctacaactgcaacacatgtggccttaatcaacaggattgcattgggcattttggcttcatcgacttggaatacccggttttccacgttggtttcttccgattagtcattcaaacactacaatgcatttgcaaggcatgtagtaaaatgcttatccaagggcaacaaaaggaggccttgctgcgccaagtgatgaacccgaatctcgactatttgcgcaaaaaagcattncataagcgggtagtaatgctcagtaagaaagtctcaatctgtgcgacatgcggattcacaaatgangtngtgaaaaaggcggttggtgccattctaaaaattgcgcanggggaaccactngcaattgaagcaatnggaccngaggccagtggcagnagcggagatggagaacagcagcaacctttgactacttcaaagttcaanctgttagatccgctcaaagttagcgaaattttccagcaaattgatttgaaggatcttccattgttgcttattggcgcggatgaatgcaagcacccagtcaatttcctcacccaacgcatcccagtcccgccagtgtgcatccgcccatccgttatttcggaattgaaatcgggctctaccgaggatgacaccacaatgaaactgaccgagattatgctgataaacgagattttgaagaagcacaagcatgatggggccccaatgaagacgatttgcgagacttgggaccatttgcagatacaatgcgcactttacatcaactcagagctgagcggtcttccaccagacatgcagccgaaaaaatttttacgctcatttgcccaacgattaaaaggaaaacaaggccgatttcgagggaatttgtcaggaaaacgggtcgactttacagcacgaactgttatttcaccggatccaaacttaaagattgatcaagttggagtgccgcttcacattgcaatgatcctcacattcccggagactgtctgccgtacaaacattgaacatatgcgtcagttgattcgcaatggggattcngttcatccgggagcaaaccacattattgatggcaaaaccggcaacaagcgntttttaagatatggcaaccgtgaattgattgcgaagaacctgcaatttggcgacatcgtagagcggcacttaaccgatggggatattgtgttattcaacaggcaaccttcattgcataaaattagcataatggcacatcgagtcaaagtaatgccgtacaggacatttagntttaangaatgtgcgtgcactccctataatgcggattttganggcgatgaaatgaacttgcatttgccacaaacttatgaagccaaagccgaggctgcccaattnatgaanatcaaatccaacttgatnagtcctcgngctgggcaaccgcttattgccgcaattcanatntttatcacagccggccacttgttaacacacaaagacacnttcttgccaaagtcagaagtncaacgcatagctgccgccattatagatattggggaaggaaggggtcaccaacgccggattcgtctgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgctccattttctacacactcttgcgcgattggggagaacaatatgccattgatgcaatgtggcgatgtgctcgcttttctgccgtatacttgtcgaatcgaggattttcaataganattggagatgtgaagcccaatgaacatttattggcagccaagcaaaagctattggacaaaggatataaaatctgtgaccgagtgaataagtcaatgaaactggagaaggaaaaggaaaagcccgattttggactcgtggatgagctggaatcaaaaattctaaaagaactttccaacattcgagatcaagcgggtaaagcatgtcgagaatacctgtgntccaaaaacaccccgctaacaatggcccagtgcggatcgaaaggttcattcatcaatattgctcaaatgattgcgctggtggggcaacaatccatttcgggcaagcgaccatccgatgggtttgagaatcgctctttgccccactttgaacgcaacgacagggcgccggatgccaagggctttgtggagaattcattctattctggccttacccctaccgagtttttcttccacacaatgggcggccgtgaaggacttgtggatacggctgttaaaactgcagagacgggctatatgcagagacgtttggtcaaatgcttggaggatttgatcattgcatacgacaatactgttcgaacgtccacaaatgaggttgtgcaatttgtnttcggcgatgatggattggatccngcttttatggaggcacatgatgggaaattggttgatctcaaacanattctcctccaagtgcgtggcaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaactatgcgaaaagaaagtacgacgcgcagttgttgaaccaggtttatacaaacaatatcatttagaaaaaactatattattncnttnctaggcactgccgttggcgcaattgcggccacatccattggggagccttctacccaaatgacgctgaaaacttttcacttcgccggagttgcctccatgaacattacgcagggtgtgccacgcattaangagattatcaatgccgtccgtaatatttccacccctataattactgttgcnttggccgatgagaaggatcaacggttggccagaagggtgaaggcccgcattgagcgcacaacattggctgaaatcagtgaatatctggagcaagtcttnctacccgatgatctctttgtgctgatcaagctgagcccangacgcatccgaacaatgcagcttgagattaccatggattccatcatngattgcatctgttcaacacgactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtcgtcgtaaaaggtttgcccagtgtgtcccgatgtgtgatgaatgcggacgagaaaaagggggatagctatcaactctttgtggagggcacttgtttcaaagaagtgttggcactcaccgagattgacggcctgcgaacaaanttcaacaatcctctcgtgattgccgaagtgttgggcattgaagcngcacggggtgcaataattagcgaaattttgaacacaatgtccgagcatgggattgagctggacaagcgncatgtgatgctactggccgacttgatgacatatcgnggagaattgcttggcatcactcgcaatggattggtgaagatgaaagaatcggttctgctgttggcttcctttgagcgcaccattgatcatttgtatgaggcngccttttttggccaacaagaccgcattgtgggtgtcagcgaatgcatcataatgggcacacccatgtacccgggcactggcatgttcaanttgctgcaacgtcaaaagcaaacgggggaggagaaagcagcgacaccannnnnnnnnnnnnnnnnnnnnnnnnnnnnn

SEQ ID NO: 196 - DNA, 354 bp, Artificial Sequence
  Description of Artificial Sequence: Synthetic polynucleotide
  modified_base (183)..(183): a, c, t, g, unknown or other
  modified_base (343)..(354): a, c, t, g, unknown or other
atgaccaagaagcgacgcaacaatggaagaaataaaaatggtcgcggacatgtgaagccaattcgttgcacaaactgcggacgttcctgccccaaggacaaggctatcaagaagttcgtagtccgcaacattgtcgaagctgcggctgtgcgggacattacggacgcttccgtctatgagaantacgcgttgcccaagctgtaccacaagctgcactactgcgtttcttgcgccatccacagcaaggtggtgcgcaatcgttcgcgtgaggctcgcaaggaccggaacccgccgccgcgttttggtcagcgtgcaaccagtgaccgtccgccacgtccagggnnnnnnnnnnnn

SEQ ID NO: 197 - DNA, 1293 bp, Artificial Sequence
  Description of Artificial Sequence: Synthetic polynucleotide
  modified_base (51)..(51): a, c, t, g, unknown or other
  modified_base (205)..(276): a, c, t, g, unknown or other
  modified_base (363)..(363): a, c, t, g, unknown or other
  modified_base (432)..(432): a, c, t, g, unknown or other
  modified_base (451)..(451): a, c, t, g, unknown or other
  modified_base (465)..(465): a, c, t, g, unknown or other
  modified_base (522)..(522): a, c, t, g, unknown or other
  modified_base (525)..(525): a, c, t, g, unknown or other
  modified_base (540)..(541): a, c, t, g, unknown or other
  modified_base (543)..(543): a, c, t, g, unknown or other
  modified_base (546)..(546): a, c, t, g, unknown or other
  modified_base (855)..(855): a, c, t, g, unknown or other
  modified_base (1095)..(1095): a, c, t, g, unknown or other
  modified_base (1222)..(1293): a, c, t, g, unknown or other
atgaagcctgacattaaagatcgagattttatgtacaagctaattgttggncaattgttctacgatggccatcagcaactggcgctgaatctggcccaatcgctgggcctttcattacgtccgccacctccatcggacaaactcttcagactggtgacagtggcccggcaatatgttgaggacccagagaccaaggagaaggaannnnnnnnnnnnnnnnnnnnnnnnnnnnnnnnnnnnnnnnnnnnnnnnnnnnnnnnnnnnnnnnnnnnnnnnttaggccccgaaccaagtttatatgagacggtttacctgacaacacataagggccctagcagagcagccgctttcacttccgatgtntcacttgttgcaactgcctctgtggattgctcaatcaaaataatggatgttgataaaatcatctcaagnattgacacgtcctcttccntgaatgagactggnccggatgcccagcacccagtcattcgcactctctacgatcatctggatgaagtcacntgngttgctttccatccnngngancaaatcctcctttctggcagcaatgacttgacgctgaaactttttgactattcaaaaactgctgtgaaacgggcaatgcgcacaattattgaagttgagccaataacagcgctttcctttcatccaagtggcgaatttttcctttgcggcactcggcatcccacccttcgcctttacaatgctgaaacgcagcaatgctttgtctcctcagtgccaaaggaccaacatacggattcaattatggatgtctgctatgcggacaatgcacgaatgtttgtgacgggcagccgcgatgggaatgtcaaagtntgggacggtatttccaaccgctgtgtcgaaaccttctccagggcacacgatggcgctcctgtctgtagtgcgcggtttacgaggaatggaaaatacgtcttgacggtgggcatggacagtgtgccaaagttgtgggaattgtccaccaaccgttgcttgattgcctacactggagcaggggcaactggcgcccgggaatttccgatggctgcttgttttaaccatactgaagattatgtnatgcttcccgacgaaaagtctggttccctttgctcctgggatgctcggaattccgaccgtgagcggttgcttgcccttggccatacggcacccacccgggcattcgtccactcgcccaccatgcccnnnnnnnnnnnnnnnnnnnnnnnnnnnnnnnnnnnnnnnnnnnnnnnnnnnnnnnnnnnnnnnnnnnnnnnn

SEQ ID NO: 198 - DNA, 1212 bp, Artificial Sequence
  Description of Artificial Sequence: Synthetic polynucleotide
  modified_base (1)..(15): a, c, t, g, unknown or other
  modified_base (93)..(93): a, c, t, g, unknown or other
  modified_base (103)..(108): a, c, t, g, unknown or other
  modified_base (315)..(315): a, c, t, g, unknown or other
  modified_base (367)..(369): a, c, t, g, unknown or other
  modified_base (603)..(603): a, c, t, g, unknown or other
  modified_base (709)..(711): a, c, t, g, unknown or other
  modified_base (817)..(819): a, c, t, g, unknown or other
  modified_base (1210)..(1212): a, c, t, g, unknown or other
nnnnnnnnnnnnnnnacagcagccaaggatcccatcgaggcaaagcaccacacttatcaattttggcaaacccagcctgtgccggctttagcnacgaagatcnnnnnntcagagaacaattatattgaccctccgctggatgtggacaagattcgaaaagagccctacacgctgcccgagccatatcaatggtctgacgtggatttgatatcaaatgagcaattggatgaactttactcgctgctcaatgaaaattacgtggaagacgatgagaatatgttccgctttgattatggccgtaacttcctcaaatgngcattaatgccctcaggctggaaacccgagtggcattgcggtgttcgggctnnnggcaatcggaaattggtggccttcattgcggctgttccggcaaagatccgcgtttatgacaaaacagttcaaatggttgagataaacttcctttgcgtgcacaagaagttgcgttccaagcggctagccccggtccttatccgtgaaattacccgccgggtcaaccaaaacggcattttccaagcgactttcaccgccggcattattattccaaaacccgtcggcacatgcagntattggcatcgatcgctgaacccgaaaaagttgattgaatccaaattctcccatctcggcaagaacatgacacttcaccgcaccgtcaagctttaccgcctccctnnngagaacgcccaatatccgctgaaaccactgtcgagagagaatttagagggcgcctacaatttgctcacggattacttgaagaatttcgacattgccccgatattcnnnagtttggacgagtttgagcatttcttcacgcccagggaggatgtcatctactcctatgtgattgagaagaaagaaggcaaagtgacggatctgattagtttctacagcttgccctccaccataatgcacaatcctctgcacaaaacaataagggcagcctattccttctacaacgtggccagcagtgtgccattgaatcgactcatgaatgatgcgttgatcatcgcaaaaactcttggttttgacgtgttcaatgcgctggacttgatggagaacaaaactttcctggaagagctcaaatttggcattggcgatggaaatttgcaatattatctctacaattggaagtgccccgatattccttccgagcgaatcggtctagtcttgcaannn

SEQ ID NO: 199 - DNA, 1254 bp, Artificial Sequence
  Description of Artificial Sequence: Synthetic polynucleotide
  modified_base (96)..(96): a, c, t, g, unknown or other
  modified_base (198)..(198): a, c, t, g, unknown or other
  modified_base (261)..(261): a, c, t, g, unknown or other
  modified_base (264)..(264): a, c, t, g, unknown or other
  modified_base (288)..(288): a, c, t, g, unknown or other
  modified_base (451)..(454): a, c, t, g, unknown or other
  modified_base (622)..(624): a, c, t, g, unknown or other
  modified_base (691)..(692): a, c, t, g, unknown or other
  modified_base (696)..(696): a, c, t, g, unknown or other
  modified_base (862)..(862): a, c, t, g, unknown or other
  modified_base (1068)..(1068): a, c, t, g, unknown or other
  modified_base (1070)..(1075): a, c, t, g, unknown or other
  modified_base (1077)..(1077): a, c, t, g, unknown or other
  modified_base (1080)..(1080): a, c, t, g, unknown or other
  modified_base (1210)..(1254): a, c, t, g, unknown or other
atggcaactgtcgacgatggcaccaatgaggagcgcctcatcaacgaggagtacaagatttggaagaagaattgtccgttcctctacgacatggtnatgacacacgcgctggagtggcccagcctgaccgtccaatggctgccggacgtgaagcgcgagggcgaggactacaccacccatcgcctcatcctgggcacncacacttcggacgagcagaaccatttggtgattgcgaagctgttgctgcccacggacgacgcncanttcgacgcttcgcgctacgacacngacaagggcgaattcggcggcttcggctcaatcacgggcaaaatcgacgtggagatcaagatgaaccacgacggggaggtgaaccgcgctcgttacatgccgcagaaccccgtgctgatcggcaccaagtcgcccaattccgaggtgttcatctttgactacnnnnagcacccctcggtgcccaacgacaaggtgtgcaagccccagctgcgcctgcgcggccacaccaaggagggctacgggctcagctggaactccaacctgagcggccacctgctgagcgcctcggacgacaccaccgtctgcctgtgggacatccaggctgactgcaatnnngccaactacctggacgccaagtccatcttcactgcgcacaccgccgtcgtggaggacgttgcttggnntgtnctgcacgacgccgtgttcggctctgttggggacgaccacaaactgatgatctgggacacgcgcaccaccaagccggcccacaccgtggacgcgcactcggccgaggtgaactgcctgtcgttcaacccctactccgagttcatcctggccaccggctcggcggatnagactgtggccctgtgggacctgcgcaacctgaagctgaagctgcactcgttcgagtcgcacaaggacgagatcttccaggtgcagtggtccccgcacaacgagaccatcctggccagctcgggcaccgaccgccgcctccacatctgggacctgagcaagattggcgaggagcagacgcccgaggatgccgaggacgggccgccngnnnnnntnttnatccatggcggccacacggccaagatcagcgacttctcgtggaatcccaacgagccatgggtgatctgctcggtgtccgaggacaacatcatgcagatctggcagatggcggacaacatctacaacgagnnnnnnnnnnnnnnnnnnnnnnnnnnnnnnnnnnnnnnnnnnnnn

SEQ ID NO: 200 - DNA, 6597 bp, Artificial Sequence
  Description of Artificial Sequence: Synthetic polynucleotide
  modified_base (1)..(108): a, c, t, g, unknown or other
  modified_base (162)..(162): a, c, t, g, unknown or other
  modified_base (186)..(186): a, c, t, g, unknown or other
  modified_base (210)..(210): a, c, t, g, unknown or other
  modified_base (277)..(277): a, c, t, g, unknown or other
  modified_base (294)..(294): a, c, t, g, unknown or other
  modified_base (297)..(297): a, c, t, g, unknown or other
  modified_base (430)..(645): a, c, t, g, unknown or other
  modified_base (991)..(993): a, c, t, g, unknown or other
  modified_base (997)..(997): a, c, t, g, unknown or other
  modified_base (1005)..(1006): a, c, t, g, unknown or other
  modified_base (1009)..(1010): a, c, t, g, unknown or other
  modified_base (1014)..(1014): a, c, t, g, unknown or other
  modified_base (1279)..(1281): a, c, t, g, unknown or other
  modified_base (1531)..(1629): a, c, t, g, unknown or other
  modified_base (1792)..(1806): a, c, t, g, unknown or other
  modified_base (2020)..(2022): a, c, t, g, unknown or other
  modified_base (2254)..(2254): a, c, t, g, unknown or other
  modified_base (2257)..(2257): a, c, t, g, unknown or other
  modified_base (2259)..(2259): a, c, t, g, unknown or other
  modified_base (2457)..(2457): a, c, t, g, unknown or other
  modified_base (2644)..(2646): a, c, t, g, unknown or other
  modified_base (2797)..(2829): a, c, t, g, unknown or other
  modified_base (2939)..(2940): a, c, t, g, unknown or other
  modified_base (3181)..(3181): a, c, t, g, unknown or other
  modified_base (3184)..(3184): a, c, t, g, unknown or other
  modified_base (3415)..(3480): a, c, t, g, unknown or other
  modified_base (3532)..(3532): a, c, t, g, unknown or other
  modified_base (3540)..(3540): a, c, t, g, unknown or other
  modified_base (3558)..(3558): a, c, t, g, unknown or other
  modified_base (3576)..(3576): a, c, t, g, unknown or other
  modified_base (3588)..(3588): a, c, t, g, unknown or other
  modified_base (3591)..(3591): a, c, t, g, unknown or other
  modified_base (3594)..(3594): a, c, t, g, unknown or other
  modified_base (3597)..(3597): a, c, t, g, unknown or other
  modified_base (3600)..(3600): a, c, t, g, unknown or other
  modified_base (3661)..(3661): a, c, t, g, unknown or other
  modified_base (3663)..(3663): a, c, t, g, unknown or other
  modified_base (3751)..(3819): a, c, t, g, unknown or other
  modified_base (4000)..(4002): a, c, t, g, unknown or other
  modified_base (4108)..(4212): a, c, t, g, unknown or other
  modified_base (4351)..(4368): a, c, t, g, unknown or other
  modified_base (4536)..(4536): a, c, t, g, unknown or other
  modified_base (4855)..(4857): a, c, t, g, unknown or other
  modified_base (4859)..(4861): a, c, t, g, unknown or other
  modified_base (5128)..(5133): a, c, t, g, unknown or other
  modified_base (5290)..(5295): a, c, t, g, unknown or other
  modified_base (5328)..(5328): a, c, t, g, unknown or other
  modified_base (5343)..(5343): a, c, t, g, unknown or other
  modified_base (5361)..(5361): a, c, t, g, unknown or other
  modified_base (5373)..(5373): a, c, t, g, unknown or other
  modified_base (5382)..(5382): a, c, t, g, unknown or other
  modified_base (5391)..(5391): a, c, t, g, unknown or other
  modified_base (5394)..(5394): a, c, t, g, unknown or other
  modified_base (5400)..(5400): a, c, t, g, unknown or other
  modified_base (5406)..(5406): a, c, t, g, unknown or other
  modified_base (5415)..(5415): a, c, t, g, unknown or other
  modified_base (5427)..(5427): a, c, t, g, unknown or other
  modified_base (5431)..(5431): a, c, t, g, unknown or other
  modified_base (5434)..(5435): a, c, t, g, unknown or other
  modified_base (5439)..(5439): a, c, t, g, unknown or other
  modified_base (5451)..(5451): a, c, t, g, unknown or other
  modified_base (5467)..(5886): a, c, t, g, unknown or other
  modified_base (6014)..(6018): a, c, t, g, unknown or other
  modified_base (6023)..(6027): a, c, t, g, unknown or other
  modified_base (6029)..(6030): a, c, t, g, unknown or other
  modified_base (6040)..(6040): a, c, t, g, unknown or other
  modified_base (6103)..(6103): a, c, t, g, unknown or other
  modified_base (6118)..(6118): a, c, t, g, unknown or other
  modified_base (6120)..(6120): a, c, t, g, unknown or other
  modified_base (6259)..(6273): a, c, t, g, unknown or other
  modified_base (6424)..(6447): a, c, t, g, unknown or other
  modified_base (6580)..(6597): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttccagagcttaacggaccccagctatgcacgccaactgcttgtgctcacntatccactgattggcaactacggngtgccggcaggcgaagacccaaantggccggaattgccgaacaaatttgagtcggaccgcgtttggccgagtgcgctcatcattggacgantgtgcccggacgggganganagtcactttgaatcggtttgctatttggaaaacataatttttttatgaaaaattccgaaaaccttaattttggagaaaatggaaaaaatccgaaaaatcttaatttttggaaaaattccgaaaaatatgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagactacgacggccttttcctgagcaacgggcccggcgatccgacaatgtgtgcgcccataatcgaacggctggctgcaattttggaggcgcgtccgaagccatttttcggcatttgtttgggccatcagctggtggcccgtgcggccgggatgacgacacagaaaatgagattcggcaaccgcggccacaacctgccagccctgcacctggacaccggccgctgcttcatcaccgcccaaaaccatggcttcgtggtggttggtgaggaaatgcctgctggatggagtgaactattcatcaatgcaaatgaccagaccaatgaggggattgtgcacgagagtnnncccnttttcagnnttnnattncatcccgaagcgtgtggaggtcccaccgacttggagcagctcttcgatgtgttcactgatgccgtcaaggcggtgaagcagggcaaaccagtgcatgttcggcaaatgattcggcaacagcttagctttgaaagcgattaccaagtacgcaaccagaggaaagtgctaatccttggctcgggcggcctctccattggccaggccggcgaatttgactactccggcgcacaagcaatcaaggcactacgtgagatgggcatcaaannnattttccagaacccgaatgtggccaccgtgcaaacaaccaaaggatttgcggatcgcacctactttctgccggtgaccaaggagatgatttgcgaggtaatcaaaaaagagcgtcccaccggcctgctgtgcacctttgggggacaaactgcgctgaactgtgccgtggacttgcacaaggagggcatcctggagcagtacaatgtgcgcgtgctgggcacacccgtggaggcaatcatgaagacggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagattggctacccagtgttggtccgagccgcatttgcacttggcggcttgggcagtggatttgctggaaaccgagaggaattgctgacaatcacccgacaagcattggcccactcaaaccaagtgctcattgacaagagtgtgtggggatggaaagaggtgnnnnnnnnnnnnnnncgggacgcctacgacaactgcatcacggtgtgcaacatggagaacattgacccggttggcattcacacgggcgaatccgtggttgttgccccatcgcaaacgctgaacaacgaggagtaccatcgactgcgggagtgcgccctgaaagtgattcgccactttggtatcattggagagtgcaatattcagtacgcgctgaatccgtacaaattgnnntactacataatcgaggtgaatgcccgtctgtcacgttcatcagcactggccagcaaggcaaccggctacccattggcctacattgctgccaaactggcattgggcgcctcactgcccgaactgcgcaactcggtcaccggcgaaacaaccgcttgctttgaaccctcactggactactgtgtggtgaaggtgccccgctgggatttgtccaagtttgcgcgcgtcagcacanagntnggcagttcaatgaaatccgtgggcgaagtgatggccattggacggagttttgaagaggcattccaaaaggcattgcgcatggtcaatgatcattatgagggcttttctccgcatatcttcaaaagagcagttacaaaagaggacctacaagaacccacggatttgcgcattttcgcgctggcccgagccctgtacagnggcaccgagttggtcgacgccatccaccagctgagccgaatcgacaaatggttcctccatcgaatgcgcgcaatcaccgacatgtacctccggttggaggagcggcaaacgttggatttgtcgggggagttgttgcgggaagcgaagcagcttgggttttccgatgcgcagattgcaaagaggattnnnagcacggaagtgaacgtgaagatggcgcgcaagcagcacaaaataatgccagtggtgaagcagattgacacggtggcggcggagtggccggcaaagaccaactatttgtacctgacctacaacggcgatgagcatgacattgcgttcagtnnnnnnnnnnnnnnnnnnnnnnnnnnnnnnnnngtttaccggattggctcctccgtcgagttcgactcctgttcggttggctgtgtggaggagttgaagcggatgggacggcaaaccattatgatcaattgcaatcctgaganngtctccacggactacgacaaatgcgaccgcctctactttgaggagatctcgctggaggtggtctcgtgcatctacgagctggagcagccaaacggcatcattctggcattcggaggccaagcggggaacaacattgccctttcgctgtctttgtccaatttccgagtgtttgggacggcaccaaagtttattgatgaggcggaggatcggttcaagttcagcagagcgttggacgatttgnagnttgaacagccaaagtggaaaaacgccaaaaaccgtcaagaggcagtgcaattttgtgagtccgtcggcttcccttgcctggttcggcccagctacgtgctctcgggggcggccatgaatgtggcccactgtgtggaggatttgcaccaatttttggaccaagcccatggaatggccggcgacaagaccgtggtggtcagcaaattcattgaggacgcaaaagaggtaaatnnnnnnnnnnnnnnnnnnnnnnnnnnnnnnnnnnnnnnnnnnnnnnnnnnnnnnnnnnnnnnnnnnggaatccactcgggcgacgccaccctggtaacacccccgcaagacctgaacnagaccacnatgaaccaaatccaaacnattgtgaagagcattgcncaacgcttcaangcnacnggnccnttcaatttgcaactgattgccaaggacaacaagctgttcgtgattgagtgcaatttacggntntcccggagtttcccgttcatctcaaaaacgctggactttgactttgtgggattggccacccgagcaatgatgtttgttgaggatccannnnnnnnnnnnnnnnnnnnnnnnnnnnnnnnnnnnnnnnnnnnnnnnnnnnnnnnnnnnnnnnnnnnnccccaattctcattctcccgtctggccggcgccgatgtggtgatgggcgtggagatgttgtccaccggtgaggtcgcctgctttggccgaagccgacaagaagcatacctgaaaggcctgctctcaaccggcttccagctcccgaaacgcgcaattttcctgtcaattggaggagtttatnnnaaagaggaaatgctgcccagtgtgcgcacattggccgaccttggctatacgctgtatggaagcaagggaactgccgacttttatgcgcggaatgaaataccggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatttgcccattcgcgggagtggcacctaccgggtgagtgcataccgaacgcatggctacaaaacgcggcgaatggccattgacaatgggatcccgctgatgaccgacatcaaatgcgcaaaattgtttattcagnnnnnnnnnnnnnnnnnncgccaaccgccggtgaatccccaattcgactgtctctccaccgagtccattgttcggctgcccggcctgattgatgtgcacgtgcatatgcgacagcctggtggtgaacacaaggagacctgggagagtgggacacgggctgccgtggccggtggcgttaccatggtnctagccatgccgaacacccatcctccactcattgatgacctctccttcaacgtggtcgactatctggcctcccaatcggcactttgcgactacgccctctacattggggccaccaccgaaaactccgcacaagccaccgaaatcgcgccaaaatgcgctgggctgaagatgtacctgaacgacacgttctccaccctgaaaatggaccggatggacaagtggatggaacatatgcgcgcatttccggcggatcgcccagtggtgtgccatgcagaggggcaaacactggccgcggtgctgttttgtgcgatgcattgtnnnannncagtgcacatttgccacgtgtccacagcggtagagattgaactgatcaagatggccaagcaacggggccaagctgttacctgtgaggtgtgcccccaccatttgttcctgacccagaaggagctgcctgaaggtgttcgagaagttcgaccacggctttccaccagtgaagactgcgaagcactttgggccaatttggactacattgattgcttcgccacggatcatgcgccccacacttgggaagagaaaacatccgaaacgccannnnnnccgcccggtttcccgggcattgaattcatgctcccacttttgatgcaagccgtacatgagggtcggttgactgaaaagcagttggtggaacgactctacacaaatccacgcaaatttttccgtcttcctgagcagccgaacacttacattgaggttnnnnnnaacgacgagtggacaattcccgagtcgggcggnttcagcaaagccggntggactccctatgccggnatgaaagtgcgnggacgagtnaaaaccgtngtnatccgnggcgtnaccgtctanatggatggtcanttcntgnnagancctgggtttggncaaaatgttcggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacacaatgacaataatgcccctgtacacggatttgttggtgcttcgccaccccagtgccgatgcctgccagcgtgccatccaagcggtgaacaaacccattgtgaatgcgggcgatggcacgggggnnnnncccannnnngnnctgttggacntgtacaccatccgggagaagctgtccagcatccatggcaagaaaattgccattgtgggcgacntgaaatatgggcggncngtccattcattggccaaaatcctatgtctctaccgtggcatcattcttcactatgtgtccccaaccgcggaacttggcatgcccgagcgcgtgaaggaatatgtggccaatggtgccaacattgtgcaggttaaatttnnnnnnnnnnnnnnnggcatcaagggtgtggacgtgatctacatgacccgcatccaaaaggagcgcttcaccaaccaggccgactatgaccgggtcaagggcaaattcgtgttgactcccagggtgttgaattcggcgagggacgaggcggaggaagattttagtnnnnnnnnnnnnnnnnnnnnnnnnccaatcatcatgcacccactgccccgggtggacgagatcagtcccgagctggacacggaccaacgggcggtgtacatgaaacaggccgagtatggactctatgtgcgcatggcactgctcacactggtgcttnnnnnnnnnnnnnnnnnn

SEQ ID NO: 201 - DNA, 1215 bp, Artificial Sequence
  Description of Artificial Sequence: Synthetic polynucleotide
  modified_base (408)..(408): a, c, t, g, unknown or other
  modified_base (532)..(1215): a, c, t, g, unknown or other
atgcctaaacacgagaaaggcacaccaaaggagattgcgaaccggcacaaatccaaaggacttcagaaattgaaatggttctgccaaatgtgccagaaacaatgccgagaccagaacggattcaaatgccatttgaccagcgaggcacatcagcgccaaatgctgctgtttgcggacaaccaaagttcgtatttgcgcgaattcagccgggaatttgaatcaaattttatacgaattctacgcagtacatttggatgcaaacgggtgaaggcaaatgatgtttatcaggaatatatcaaagacaagggtcatatccacatgaactccactgtttggcacacacttaccggcttcatcctctaccttggcaaatccggcaaatgcaaaattgacgagaatgagaaagantggcacatccaatacattgaccaagaagaggaaatccgccgagagaaaatgcaacaaaaggcaaagcaggagaaggatgacgaggagcgcatgcaggagcatttgcagcgacagattgaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 202 - DNA, 1515 bp, Artificial Sequence
  Description of Artificial Sequence: Synthetic polynucleotide
  modified_base (1)..(846): a, c, t, g, unknown or other
  modified_base (1002)..(1002): a, c, t, g, unknown or other
  modified_base (1465)..(1515): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagcccccagaacggggcaaaagggttcaaacaagaggtcaacaagtggattgtgctcgtccaattgctcattggtgaaattcccgaacgaagccttttccgcaccaaagaactcgaggaagtgctcaaaccgtacctccaattgactcaagtngtgcgacttggcgatgttgaagggtacaagaaggtgaaggaggaattcacttcgagattcttggaagacaacacgatgaccctggtcgagcgcatccatcaaagcgtgatccggactgcaatccgtcaaatctcgctcacttattcgcgcatattcattgccgatgttgctgttaaactgcagtcgccaacagtggaggatgcgcacgacacggtgatgaaagcaatcaaggagggcattttgcgggccgtcattaccaacgacccggcattcaaggagcagtatgtcaagtttggcgagaccgacgaccagtaccgtggcacggaaccacagaaggaatttgacaaacgcatcaatgaactcttggaattgtacaatcaggccgtgaaggcgctcaaatacccggacaatcggaatcccgaggttgagaccatcgaagagcagcgcaaacgtgaacaagagnnnnnnnnnnnnnnnnnnnnnnnnnnnnnnnnnnnnnnnnnnnnnnnnnnn

SEQ ID NO: 203 - DNA, 1308 bp, Artificial Sequence
  Description of Artificial Sequence: Synthetic polynucleotide
  modified_base (282)..(282): a, c, t, g, unknown or other
  modified_base (285)..(285): a, c, t, g, unknown or other
  modified_base (312)..(312): a, c, t, g, unknown or other
  modified_base (822)..(822): a, c, t, g, unknown or other
  modified_base (824)..(825): a, c, t, g, unknown or other
  modified_base (1056)..(1056): a, c, t, g, unknown or other
  modified_base (1156)..(1156): a, c, t, g, unknown or other
  modified_base (1158)..(1158): a, c, t, g, unknown or other
  modified_base (1160)..(1162): a, c, t, g, unknown or other
  modified_base (1164)..(1164): a, c, t, g, unknown or other
  modified_base (1166)..(1166): a, c, t, g, unknown or other
  modified_base (1171)..(1171): a, c, t, g, unknown or other
  modified_base (1176)..(1176): a, c, t, g, unknown or other
  modified_base (1185)..(1185): a, c, t, g, unknown or other
  modified_base (1194)..(1194): a, c, t, g, unknown or other
  modified_base (1200)..(1200): a, c, t, g, unknown or other
  modified_base (1206)..(1206): a, c, t, g, unknown or other
  modified_base (1215)..(1215): a, c, t, g, unknown or other
  modified_base (1227)..(1227): a, c, t, g, unknown or other
  modified_base (1269)..(1269): a, c, t, g, unknown or other
  modified_base (1306)..(1308): a, c, t, g, unknown or other
atgataggcggtttattcgtttacaatcacaaaggggaggtgctaatctcacgcatttatcgtgacgatgttaaccgaaatgctgttgatgctttccgtgtttccgtgatccatgccaggcaacagatccgaagtccggtcaccaacttggcgcgcacctcgtttttccacatcaaacgcggcaatgtgtggatttgcgcggtcactcggcacaacatcaatgcctcaatggtttttgagtttctgaatcgctttgcggacacaatgcaatcctactttggnaanctgaacgaggagaatgtgaagaacaantttgtgctcatctacgaactgctggatgggattctcgactttggttatccccaaaacactgacccaggcgtgctcaaaacattcatcacccaacaaggcgttcggactgcgagcaaagaggagcaagcccaaatcacatcccaagtgaccggccaaattggatggcgtcgtgagggcatcaaatacagacgcaatgaactcttcttggacgtcattgaatacgtgaatctgctgatgagtcaacaagcccaagttctgtccgcccatgtggccggaaaagttgcaatgaaatcgtacttgagcggaatgcccgagtgcaagtttggcatcaacgacaaactcaccattgaaggcaaagggcgcgcaggcagtgaggacccaaacaaatcgacacgtgcttccgtggccattgacgattgccaattccaccaatgcgtaaagctgaccaaattcgacacggaacacgcgatcagcttcatcccacccgacggagagtatgaattgatgagntnncggaccaccaaggacatccagctgccattccgagtcatcccattggtgcgtgaagtttcacgtaacaaaattgaagtcaaagttgtcatcaagtccaacttcaagccctctctgttggcccaaaagattgaagtgcgcattccaacaccgcccaacaccagtggggtgcaactgatttgcatgaagggcaaggccaaatacaaggcaggcgaaaattgcatttgctggaanattaaacgaatgggcggcatgaaagaatctcagatttcggccgaaattgacctgctgaacacgggaacggccgagaagaagaagtggaatcgtccgcccntntnnntnanttttnaggtnccatttgcnccatccggnctgaangttcgntacctgaangtgttcgaaccnaagctgggctactccgaccatgatgttgtcaaatgggtgcgntacattggccgttccggcctctacgagacaagatgcnnn

SEQ ID NO: 204 - DNA, 735 bp, Artificial Sequence
  Description of Artificial Sequence: Synthetic polynucleotide
  modified_base (1)..(12): a, c, t, g, unknown or other
  modified_base (27)..(27): a, c, t, g, unknown or other
  modified_base (45)..(46): a, c, t, g, unknown or other
  modified_base (48)..(55): a, c, t, g, unknown or other
  modified_base (57)..(60): a, c, t, g, unknown or other
  modified_base (62)..(62): a, c, t, g, unknown or other
  modified_base (64)..(68): a, c, t, g, unknown or other
  modified_base (70)..(72): a, c, t, g, unknown or other
  modified_base (82)..(87): a, c, t, g, unknown or other
  modified_base (89)..(90): a, c, t, g, unknown or other
  modified_base (92)..(93): a, c, t, g, unknown or other
  modified_base (95)..(95): a, c, t, g, unknown or other
  modified_base (97)..(97): a, c, t, g, unknown or other
  modified_base (99)..(99): a, c, t, g, unknown or other
  modified_base (101)..(101): a, c, t, g, unknown or other
  modified_base (103)..(106): a, c, t, g, unknown or other
  modified_base (108)..(110): a, c, t, g, unknown or other
  modified_base (120)..(120): a, c, t, g, unknown or other
  modified_base (122)..(123): a, c, t, g, unknown or other
  modified_base (183)..(183): a, c, t, g, unknown or other
  modified_base (211)..(211): a, c, t, g, unknown or other
  modified_base (213)..(213): a, c, t, g, unknown or other
  modified_base (215)..(216): a, c, t, g, unknown or other
  modified_base (220)..(221): a, c, t, g, unknown or other
  modified_base (279)..(280): a, c, t, g, unknown or other
  modified_base (282)..(283): a, c, t, g, unknown or other
  modified_base (286)..(292): a, c, t, g, unknown or other
  modified_base (294)..(294): a, c, t, g, unknown or other
  modified_base (297)..(297): a, c, t, g, unknown or other
  modified_base (299)..(300): a, c, t, g, unknown or other
  modified_base (376)..(588): a, c, t, g, unknown or other
  modified_base (733)..(735): a, c, t, g, unknown or other
nnnnnnnnnnnncaaaagctgcccacngtgcccgagactgtgctnnannnnnnnnannnncngnnnnncnnncgcgccgggnnnnnnannannangncnancnnnntnnngaaagccaangnnaaaaaggcggaaatcttcaagcgtgccgagcagtacctggtcgcctatcgcaagaagcanaagcagctgttggcgctgaagcgtcagncnannaagnngggcaacttctacgtgcccgatgagcccaagctggcctttgtggtgcgcatcaagggnntnnacnnnnnnnanccncnnccgcgcaaagtgctccaactgctgcgcttgcgccaaatcaacaacggggtgttcgtcaagctcaacaaggccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagaaggtcaccaacttcctgtggcccttcaagctgagcaacccggtgggcggcttcaacaagaagtccaaccacttcgtggagggcggcgactacggcaaccgcgaggaccagatcaacaagctgctggagcgaatgattnnn

SEQ ID NO: 205 - DNA, 1320 bp, Artificial Sequence
  Description of Artificial Sequence: Synthetic polynucleotide
  modified_base (1)..(195): a, c, t, g, unknown or other
  modified_base (379)..(804): a, c, t, g, unknown or other
  modified_base (940)..(1077): a, c, t, g, unknown or other
  modified_base (1194)..(1194): a, c, t, g, unknown or other
  modified_base (1309)..(1320): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggagccagtgaattttgacttcctgattgatgcaattttgttgagaacaacattgtttgacttccttcaaacttacaacatttcggtggaaaacattctcaagatcgaatgcatccaacagtcgacaccaccacaaccccatctggacttatccgactcagaatgggtggcggatttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagattccgatggtcacattggaggcccatcgcgaggcagtggttgccatcagttggagtccgctcgaacctgggcgcgccgtcaccgtctcttgggaccaccaaatgctggtttgggatttggagttggcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagcacctacgcgggccacactggatggatttcggatgtttgttggtgcccggacagagagaatctcttcgcaacttcaagtttcgacaaaaccgtgaaaatgtgggacacaagnagtcccaaggcagcgctttacgacttgatgggccatcaggaccgagtgctttgtgttcgactggtgaccgagagaatagcaagcggttcggtggactgcactctgaaagtcttcnnnnnnnnnnnn

SEQ ID NO: 206 - DNA, 1608 bp, Artificial Sequence
  Description of Artificial Sequence: Synthetic polynucleotide
  modified_base (1)..(27): a, c, t, g, unknown or other
  modified_base (44)..(44): a, c, t, g, unknown or other
  modified_base (78)..(78): a, c, t, g, unknown or other
  modified_base (111)..(111): a, c, t, g, unknown or other
  modified_base (135)..(135): a, c, t, g, unknown or other
  modified_base (144)..(144): a, c, t, g, unknown or other
  modified_base (168)..(168): a, c, t, g, unknown or other
  modified_base (180)..(180): a, c, t, g, unknown or other
  modified_base (213)..(213): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (252)..(252): a, c, t, g, unknown or other
  modified_base (270)..(270): a, c, t, g, unknown or other
  modified_base (292)..(292): a, c, t, g, unknown or other
  modified_base (309)..(309): a, c, t, g, unknown or other
  modified_base (321)..(321): a, c, t, g, unknown or other
  modified_base (324)..(324): a, c, t, g, unknown or other
  modified_base (333)..(333): a, c, t, g, unknown or other
  modified_base (339)..(339): a, c, t, g, unknown or other
  modified_base (362)..(363): a, c, t, g, unknown or other
  modified_base (365)..(365): a, c, t, g, unknown or other
  modified_base (372)..(372): a, c, t, g, unknown or other
  modified_base (648)..(648): a, c, t, g, unknown or other
  modified_base (748)..(750): a, c, t, g, unknown or other
  modified_base (1251)..(1251): a, c, t, g, unknown or other
  modified_base (1254)..(1254): a, c, t, g, unknown or other
  modified_base (1257)..(1260): a, c, t, g, unknown or other
  modified_base (1361)..(1362): a, c, t, g, unknown or other
  modified_base (1392)..(1392): a, c, t, g, unknown or other
  modified_base (1411)..(1413): a, c, t, g, unknown or other
  modified_base (1416)..(1416): a, c, t, g, unknown or other
  modified_base (1455)..(1455): a, c, t, g, unknown or other
  modified_base (1467)..(1467): a, c, t, g, unknown or other
  modified_base (1471)..(1608): a, c, t, g, unknown or other
nnnnnnnnnnnnnnnnnnnnnnnnnnnccaacacaggaatccanggacgaatggtcaagtttggtcacgcgcgatccntggtttaaagggcacgaatcgtccaatagcaangctgttgttatcaaagaaccaccnccatatggncgccgtcaaggttttgtgccacgnacacccgaggantttggcgatggaggcgcctttcccgaaatccanattgcccagttnccactngtnatgggaatggacaaaccnggcacgggcgcgaagaanacagtggcactccagtttgatncggaaggcaagctgcgnttcgatgaaatngcncgtattggncatggnaaggacaaggttcattttgcttnntnatattcnatgaaatcgaaaataattgatgacaatgacgaatctttccacaagccaacagaagaggagatccgcgaaacgacggaagccacacgccaagctttggagaagatcacaactgcaaagattgccgccgcattgccggtgcaacacgcaaaaaagaccgcaccttcccaatacattcgctatacgcccagccaacagtcgggagcaggcggagcccaacagcgcataatccgacttgttgaggagcaaaaggatccaatggagcctcctcgtttcatnataaatcagaaaataccacgtgcaccaccttctccgccagccccggtaatgcattcaccaaccagaaaggttagcgcaaaggagcaagcggattggaaannnccgccatgcatttccaactggaaaaatcccaaaggttacacagtggccctcgacaaacggctggcggctgatgggagaggtttacagcaagtgcatatcaatgagaattttgcgaaaatggccgaggcactcagtattgccgagcgcaaagcacgtgaagcggtcgaaacccgcgcacaaatggagcgccgaattgcgcaaaacaagaagactgagcaggagaagcggatgcgagaaatggcccagaatgcacgattggctcgggctcaggcgctacgcaaagcggaggaagaagaggatgaagcaaaagaacgcgaggcaatacgacgagatcgcattgaggaccatcgtcgtgagcgtaatattgcacgctctcggcccgacaagttggagaagctgaaacgcgacaaagagcgcgacatcagcgagaaaattgctttgggattgcccgactcgcgggctagagccagcggcgaaacacaattcgactcgcgtctgttnaancannnncagggtcttgacagcggtggcatcgatgatgagacatacgcagcctatgataagccgtggcgaccacaagacaatgtccaacaacacatttatcgcccagnnaaagacatcgacagcagcatttatggtgcngatttggaccgcatcatcnnnagnaccaaccgatttgttccggacaagggcttttcgggaacngagggcggcggncaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 207 - DNA, 834 bp, Artificial Sequence
  Description of Artificial Sequence: Synthetic polynucleotide
  modified_base (1)..(48): a, c, t, g, unknown or other
  modified_base (649)..(834): a, c, t, g, unknown or other
nnnnnnnnnnnnnnnnnnnnnnnnnnnnnnnnnnnnnnnnnnnnnnnncgcccgggcccgttcgacttttccaacgtggaacgcaatttggctttgtgcgaaatgggcggtgctttgcccaaagcaatgtcgacgggaacaaccattgtggcttctctttacaaggatggcgtgatgatcggtgccgactctcgcagcacaatgggccatatcattgccaacaaaaatgccatgaaactccatcgcatcacagacactatctacgctggaggtgccggaacagccgctgatttgggaaaagtgacccagatgattggcgccgagatgaagatgtacgaactgaacaatggcaaaaaggcgcgagtcatcatggcacaccgtcgccttcgcactacctctatcaggtaccaaggccatattggcgcctatttgctcatcgggggtgtggatgcaaccggtcccaatctctacgaggtgagcgccagtggctctggctacagcaagcccttcggtgcggatggttccggatcattttgtgccattgccgagatggaagcccgcttcaagaaggacatgacggagcaagaatgtcgcgatatgatcatcaaagcggttgaggcgggcatgcatggcgacaacatgtctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 208 - DNA, 588 bp, Artificial Sequence
  Description of Artificial Sequence: Synthetic polynucleotide
  modified_base (1)..(81): a, c, t, g, unknown or other
  modified_base (198)..(198): a, c, t, g, unknown or other
  modified_base (213)..(213): a, c, t, g, unknown or other
  modified_base (219)..(219): a, c, t, g, unknown or other
  modified_base (324)..(324): a, c, t, g, unknown or other
  modified_base (348)..(348): a, c, t, g, unknown or other
  modified_base (435)..(435): a, c, t, g, unknown or other
  modified_base (439)..(439): a, c, t, g, unknown or other
  modified_base (441)..(441): a, c, t, g, unknown or other
  modified_base (447)..(447): a, c, t, g, unknown or other
  modified_base (583)..(588): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnagagctcaattggcttctacagcaccgccattgggacctcagcttggccaacgcggcgtgaacgttgccaatttctgcaaagatttcaatgcgcaaaccgcaaacattaagaatgtngccataatgccggtnagcatncatgtgaagccggatcgaacatacgatttggacattggcacaccaacgacgggctggcttctcttccaagctgcaggcacacgacggccaaagcaaaaaccaacngaggtggttggctggctctccgtnaagcacatctacgaaatcgccaaaatcaagtcgcacgacaaaaccatgatcggagtgccgatgaaggaaatctgccagctggtcatncagngngcacgncaaacgggttttagagtgcaatacgaggacctcgagccggaccagctacaacagttcctcgacgcccatcgagcaaaaattcaggccgatattgaaaggaaagcccaatatgaagctgccaaactggctaggactnnnnnn

SEQ ID NO: 209 - DNA, 618 bp, Artificial Sequence
  Description of Artificial Sequence: Synthetic polynucleotide
  modified_base (1)..(24): a, c, t, g, unknown or other
  modified_base (208)..(210): a, c, t, g, unknown or other
  modified_base (616)..(618): a, c, t, g, unknown or other
nnnnnnnnnnnnnnnnnnnnnnnngactacctgttcaaactgctgctgatcggcgactccggtgttggcaagtcctgcctgctgctgcgattcgcggacgacacctacaccgagtcgtacatttccaccattggcgttgactttaaaattcgcacaatcgaactcgaggggaagacaataaagcttcaaatttgggacacggccggcnnngagcgcttccgcacaatcacgtccagctactaccgcggcgcgcacggcatcattgtggtctacgacatcacagaccaggactccttcaacaacgtgaagcaatggctgcaggagattgaccgatacgcgtcggagagcgtcaacaaactgctggtgggcaacaagtgcgacttgaccaacaagcgtgccatcgagaccaacgtggccaaggagtacgcagaccaactgaacattccattcctggagacttcggccaagaactccaccaatgttgagcaggcattcatcacgatggccaccgagatcaagaaccggatgggtccgctgcaacaggccggcaacgcctcagccgtgcgcattggtccgtcgcagccggtgcaggataagaagtcgggagggtgctgcnnn

SEQ ID NO: 210 - DNA, 729 bp, Artificial Sequence
  Description of Artificial Sequence: Synthetic polynucleotide
  modified_base (1)..(171): a, c, t, g, unknown or other
  modified_base (239)..(239): a, c, t, g, unknown or other
  modified_base (330)..(330): a, c, t, g, unknown or other
  modified_base (387)..(387): a, c, t, g, unknown or other
  modified_base (404)..(404): a, c, t, g, unknown or other
  modified_base (586)..(586): a, c, t, g, unknown or other
  modified_base (588)..(591): a, c, t, g, unknown or other
  modified_base (594)..(594): a, c, t, g, unknown or other
  modified_base (727)..(729): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtactgccaaaaaccgagcaagatcataaaataaccgaatattttcctgttcgccggagtaatcgtanaactgcaaaagaaatcgaggattcaaatatgaagatgatttatcaattggtgaaaactggatgcaatgaggattacttggaaatctacacntgtgaaacaaagggtcgtggcatccggtctttgaaggaattcagcaaaggagaattngttgtcgaatacaaagntgacttgatcagctctaaaatggcacagctgcgcgaagaggagtattcgaaagacgagggcatcggctcgtacatgtactatttcaagcatcgtgacagggaatattgcgttgatgctaccaaagaaacaatgttcaaagggcgcctcataaatcacagcttcttaaggccaaatttgaaancnnnngtnattgaatttccaacgagtttccacctcatactcatcgccaaaagagacatcgatatcggggaagagttgctttatgactatggagagcgacgacctgaaatcattgccaagaacccatggctcatcaactccnnn

SEQ ID NO: 211 - DNA, 3384 bp, Artificial Sequence
  Description of Artificial Sequence: Synthetic polynucleotide
  modified_base (1)..(405): a, c, t, g, unknown or other
  modified_base (444)..(444): a, c, t, g, unknown or other
  modified_base (465)..(465): a, c, t, g, unknown or other
  modified_base (481)..(481): a, c, t, g, unknown or other
  modified_base (515)..(515): a, c, t, g, unknown or other
  modified_base (648)..(648): a, c, t, g, unknown or other
  modified_base (709)..(709): a, c, t, g, unknown or other
  modified_base (711)..(712): a, c, t, g, unknown or other
  modified_base (714)..(714): a, c, t, g, unknown or other
  modified_base (718)..(720): a, c, t, g, unknown or other
  modified_base (726)..(726): a, c, t, g, unknown or other
  modified_base (735)..(735): a, c, t, g, unknown or other
  modified_base (768)..(768): a, c, t, g, unknown or other
  modified_base (792)..(792): a, c, t, g, unknown or other
  modified_base (820)..(820): a, c, t, g, unknown or other
  modified_base (837)..(837): a, c, t, g, unknown or other
  modified_base (879)..(879): a, c, t, g, unknown or other
  modified_base (1155)..(1155): a, c, t, g, unknown or other
  modified_base (1507)..(1668): a, c, t, g, unknown or other
  modified_base (1842)..(1842): a, c, t, g, unknown or other
  modified_base (2146)..(2148): a, c, t, g, unknown or other
  modified_base (2187)..(2187): a, c, t, g, unknown or other
  modified_base (2205)..(2205): a, c, t, g, unknown or other
  modified_base (2284)..(2337): a, c, t, g, unknown or other
  modified_base (2403)..(2403): a, c, t, g, unknown or other
  modified_base (2593)..(2593): a, c, t, g, unknown or other
  modified_base (2595)..(2597): a, c, t, g, unknown or other
  modified_base (2599)..(2599): a, c, t, g, unknown or other
  modified_base (2601)..(2601): a, c, t, g, unknown or other
  modified_base (2603)..(2603): a, c, t, g, unknown or other
  modified_base (2605)..(2605): a, c, t, g, unknown or other
  modified_base (2679)..(2679): a, c, t, g, unknown or other
  modified_base (2779)..(2889): a, c, t, g, unknown or other
  modified_base (2985)..(2985): a, c, t, g, unknown or other
  modified_base (3364)..(3384): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggtggatattttatcgtcaatggctcggagaaagtnatccgcctgctggttgcaaanaaacggaattatccantggccattcggcgaaaaacatttcgagagagagnaaaactctactccgattgtgccataatgatgcgctgttttcggggcaatcacctttgttcattgatcactttgcactatcttgaatcatgcgcaatgactttggcaattcagtatcgccgtcaacttttttancttcctttgatgtacatcctgaaatgcttggtcgactggaatgatgctcaaatttacgccnanntnacgnnnggtcgntccggtgancatttttggtcaaattgcgttcgcaacatgctnacattggcacagggcgaaggaatnatttcccagaaaacagcgcttaacacantgggaaaacattttcgnattgcccttggcgagcggattgctccttgggaggacaatganaccgcctgccgttttcttcttcatcagtgtctggcaatacatttaaagacggacgaggaaaagttttattgtctaaccttgatggctcgcaaattggttggacttgttaaaaacgaagtacacgacgagtcattggataatccccaatttcaagaagcttccgtgtccggtcatattgttctgctgttttgctatgaacgattggaaaatttattgttaatagcacgcaagaagttgagcattgtggcggaacggcgatcgttcaaatttacccgnaaagaattccttcgagcccttggatcacaacgaaacaatgaactgacccggggcatggaatacttcttggccactgggaatctgataacccgcaccgggattggtttgatgcaagagactggatttgctgttgccgctgaacgaatcaatcaattgcgttttgtcagtcattttagggcaatccacagaggcgcttttttcacggaaatgcgaacaaccgatgtgcgaaaattacgacctgaagcatggggattcatttgtccggtacatactcctgacggagctccatgtggcttgctgaatcatgtgacggcctcaatcgacataatgacgaactttgcaccaaattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtttatttggatgcgcagatccatccctatactgaattgacattgatccgacaatcgcccgatcctcaaaacattcaaacgcaattcccaggcctctacatctatacagtgccaggccgtatggttagaccagtgaggaatttgctgtttgacggaaaggaatatattgcnatttttgagcaagtttacctttccatcatcattgatccagaagaggcagaacccggtgttacgatgcatcaagaattgcatccttccacactattctcctttgccggcaatcttattccattccctgaccataaccagtctccacgcaacgtttaccaatgccaaatggggaagcagacaatgggtgttcccgtccatgcttggcgctacagggccgacaacaaaatgtatttgcttcaaatgccgcagaaaccattgctgaagttggagtcacatgacaaagtaccaatggacgagtacccgnnnggcacaaatgcttgtgtggcagtcatctcatacacagcntatgacatggaagacacnatggtcataaaccgggcatcctatcaacgtggttttgcccatggtacggtcataaaggtggagcgcatcaatttggtgnnnnnnnnnnnnnnnnnnnnnnnnnnnnnnnnnnnnnnnnnnnnnnnnnnnnnnagcataggcccggatggtcttcccatacagggacgtatgtatacgcaagatgaactttattgccgnacattcaacatgatcagtggaaaatttagaaagaacaaattcaaatacagtgagcccgcctactgtggatatgtgcgaattgtgcaagatgaaaacgtgccagactctaaagttcacattctcatccagtggcgcattcaaaggaatccaatcatcggcgataaatttgcttctcggcacggccaaaaangnnntnantncnttctatggccgccagaatcgctgccattttctgaatctggaatggtgcccgatataatcttcaatccacacagntttccctctcgaatgaccattggcatgatgattgaaagtatggctggaaaagcggcggcaatgcatggtgcgcattacgatgcgtcgccttttgttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaaatcttctttggaattgtctattaccaaaggttgcggcacatgatttctgacaaattccaagtgcgctccaccggaccagtggattcatcnacactacaaccaataaagggcagaaagaagggcggcggaattcgttttggtgaaatggaaagggacgcactcattgcccatggatccgcttttgtttgcaggtttattgctgttcaattgtcggacaaggaagaggtgcaaatgtgcgcccgttgctgctccataatttccgtctctcaattgaaacccagctttgcatagctatcaaaatatcgctctacagactttcatcagaaccagaaatttacacggacgcattgtttcatttgccataaagacgacgaaatattccaggtgcaagtgccaagagtgttccgttatctttgtgccgaactttgcgccgtcaatgtgaaacttcaactctccgtggcacatccgnnnnnnnnnnnnnnnnnnnnn

SEQ ID NO: 212 - DNA, 1788 bp, Artificial Sequence
  Description of Artificial Sequence: Synthetic polynucleotide
  modified_base (1)..(21): a, c, t, g, unknown or other
  modified_base (65)..(65): a, c, t, g, unknown or other
  modified_base (123)..(124): a, c, t, g, unknown or other
  modified_base (126)..(129): a, c, t, g, unknown or other
  modified_base (132)..(133): a, c, t, g, unknown or other
  modified_base (135)..(136): a, c, t, g, unknown or other
  modified_base (138)..(141): a, c, t, g, unknown or other
  modified_base (228)..(228): a, c, t, g, unknown or other
  modified_base (315)..(315): a, c, t, g, unknown or other
  modified_base (546)..(546): a, c, t, g, unknown or other
  modified_base (556)..(558): a, c, t, g, unknown or other
  modified_base (580)..(580): a, c, t, g, unknown or other
  modified_base (587)..(587): a, c, t, g, unknown or other
  modified_base (603)..(603): a, c, t, g, unknown or other
  modified_base (616)..(618): a, c, t, g, unknown or other
  modified_base (627)..(627): a, c, t, g, unknown or other
  modified_base (666)..(666): a, c, t, g, unknown or other
  modified_base (675)..(675): a, c, t, g, unknown or other
  modified_base (849)..(849): a, c, t, g, unknown or other
  modified_base (903)..(903): a, c, t, g, unknown or other
  modified_base (915)..(916): a, c, t, g, unknown or other
  modified_base (966)..(966): a, c, t, g, unknown or other
  modified_base (969)..(969): a, c, t, g, unknown or other
  modified_base (1059)..(1059): a, c, t, g, unknown or other
  modified_base (1133)..(1133): a, c, t, g, unknown or other
  modified_base (1138)..(1138): a, c, t, g, unknown or other
  modified_base (1145)..(1145): a, c, t, g, unknown or other
  modified_base (1187)..(1187): a, c, t, g, unknown or other
  modified_base (1193)..(1193): a, c, t, g, unknown or other
  modified_base (1206)..(1206): a, c, t, g, unknown or other
  modified_base (1240)..(1241): a, c, t, g, unknown or other
  modified_base (1327)..(1332): a, c, t, g, unknown or other
  modified_base (1518)..(1518): a, c, t, g, unknown or other
  modified_base (1558)..(1566): a, c, t, g, unknown or other
  modified_base (1689)..(1689): a, c, t, g, unknown or other
  modified_base (1774)..(1788): a, c, t, g, unknown or other
nnnnnnnnnnnnnnnnnnnnnataaataaaattgttttaaattctaaaaaacaacaacagaatancacaacgcgcgaccaaatccaacgcctggtggatcagaagaaatacgacgagcttttnnannnnttnnanngnnnnctggcgtttggcacagcagaagtccgcgctcgaatgggagccggctttacgcgcctcaatgacttgaccatcctgcaattgtcgcanggatttgccaagcatttggtcaccgaactcaacaaatccgagccagccattgtcattggctacgatggacggcataacagcaaaagnttcgcacaattgtcggcaaatgtgtttgtgcagaacggaatccgagtccatctgttcagcgactacgtgcccacaccggttgtttcgtttgcggtggccgagttgaagtgcgatgctggactcatgatcaccgcctcccacaatcccaaggaggacaacggctacaaagcctactggaacaacggggcccaaattctggcaccgcacgatgggaaaatttgtgaaattgcncgcagcgacnnntcactcaaaccggaatattggntgcttgnccagcttgaggagcanccactgctcgtgnnnatggaaccnttgatgggcgcatatttcaagaaggagagtgggattaantttttcagntctctgaacagcacatcccaactgcgcatcacctattccgcattccacggggttggctcaaaatttgcccggcaaatgttcgaggagttcggctttcccgctgcgaacatttcctacgtcaaggaacaagatgagcccaaccccgacttcccaaccgtgccattcccaaacccngaggagggacatcgcgttttgcaactgtgctttcgcactgccgacgccaacaangcgcagctgatnntggccaatgacccggatgctgaccggctgcagttggccgagaaacagccnganagcaaatggcgcgtgttcaccggcaacgagatgggcgcactggccagctggtggctttggacccaatggcgtcaacgcaatccccaagcngaccccgcccacgtgtacatcctgaacagtgcggtctcctcacagattgtcgcaacaatggcgcagaaagaagntttcnaaaatgncgtttccctgaccggcttcaaatggattgggaatttggcggnccaacngcgtgccaagggngaaaccgtcattttggcatgggaagagtcgattnntttattttttaaatttatttttccccaggatggaatccttgcggctgccgtctttgccgagatggccaactggctgcacacccaannnnnnacccttcaacaacaactcttcgccatctacgggcaatatggctttcatttgaccaaaaactcctgctggattgtgcccgggcctgaggtggtcaaggagctgtttgccgacttgaggggcaatggcaactcaattgaggagtatcccgaggcaatgggtgcgagtgggcgcatcaaatttgttgtnttcgacaattccaagccgaacaacaaagccgtgctcccannnnnnnnntcgtcggaaatggtcaccttcacactggacacagacagcattgtcacactgcgggccagtggcaaggagcccaaagtgaagtactacattgagttgcgcacgggagagggcaaagctgagagngatttgccggaggtgcagcacgcactggcccaattggagaaggacgtggtggacacgctgttgctgccgaaaaagattgatttgnnnnnnnnnnnnnnn

SEQ ID NO: 213 - DNA, 1485 bp, Artificial Sequence
  Description of Artificial Sequence: Synthetic polynucleotide
  modified_base (1)..(435): a, c, t, g, unknown or other
  modified_base (1233)..(1233): a, c, t, g, unknown or other
  modified_base (1456)..(1485): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccaaaagcacaggatggcacagtgcgcgcattgctcccgtcacgagccaatctcattaccaagccgaaatggcatgctccttggaagctctatcgcgtgatctcggggcatactggctgggtacgtgcaatcgatgttgaaccaaacaatgaatggtttgcttcgggtggagccgatcgaattgtcaagatatgggatttggccagcggtcatttgaaactctcattgactggtcacatcagtgcggttcgtgccgtgaaagtttcaccgcgccatccttatcttttcagtgccggtgaagacaaacaggttaaatgctgggatttggagcagaataaagtggttaggcattatcacggccatttgagtgcggttcaggacttggcattgcacccaacgcttgacatacttgttacatgcgctcgagattcaactgccagggtttgggatatgcgaacaaaggctcagatattctgcttcagtggacatcgagacaccgttgcttccgtggtctgccaatcatctaatccgcaagtggttactggcagccatgactcaacaataaaattgtgggatttggcaagcggtaaaagtgtttgcaccctcaccaaccataagaaaagtgttcgatccttggcccttcatccaactctaaacatgtttgcttctggttctacagacaatatcaaactttggaagtttcccaatggcgagtttatgcaaaacttgagtggccacaacacaatgataaactcattggctatcaacgaagatggagtgcttgtgtctggagtngatgtcggaacaatgcacttttgggatttcaagtccggcttttgcttccaaaaggaacatcctcctgctcaaccgggctcaattgactctgaacgcggcatattcgcattgtgctttgataaatccggcacccgtttgatcacagctgaggcagacaaatccatcaagatgtggaagaggatccagaagcggaccgaggaaacacacccattgacatggcgcnnnnnnnnnnnnnnnnnnnnnnnnnnnnnn

SEQ ID NO: 214 - DNA, 543 bp, Artificial Sequence
  Description of Artificial Sequence: Synthetic polynucleotide
  modified_base (1)..(6): a, c, t, g, unknown or other
  modified_base (22)..(24): a, c, t, g, unknown or other
  modified_base (369)..(369): a, c, t, g, unknown or other
  modified_base (502)..(543): a, c, t, g, unknown or other
nnnnnngaagagccaatacgcnnngtcaacaagtgggatggcgccaatgtgaagaacacgctggatgacaccgtaaaaaggatcataaacgacaactatggctggtccgaacgacacacgctggccaatggccgattggcgctttcattcttggcagtggcattcgctggattcgcactcatctacgactatttctacccatttccccaatccaaacacattctcgccttttgctcaatcagctactttgtcatgattttcatcctgcaaacatatcaatggtatgtggagaagctgaccttcttccaggccgtggagaaggagggaaagcagcagcgttactggaaatggtcctccgacatgaaacgntatgatgacaaatacgtgctgatcgcggagtactcgcagggcgcccgatcgggcagcatgaagatggtcaagtcggtgggcgcctacatcagcgaggatggcgaagtgctgctcccactggtgaagaagaagnnnnnnnnnnnnnnnnnnnnnnnnnnnnnnnnnnnnnnnnnn

SEQ ID NO: 215 - DNA, 1314 bp, Artificial Sequence
  Description of Artificial Sequence: Synthetic polynucleotide
  modified_base (1)..(30): a, c, t, g, unknown or other
  modified_base (36)..(36): a, c, t, g, unknown or other
  modified_base (51)..(51): a, c, t, g, unknown or other
  modified_base (63)..(63): a, c, t, g, unknown or other
  modified_base (105)..(105): a, c, t, g, unknown or other
  modified_base (113)..(114): a, c, t, g, unknown or other
  modified_base (117)..(117): a, c, t, g, unknown or other
  modified_base (119)..(122): a, c, t, g, unknown or other
  modified_base (124)..(127): a, c, t, g, unknown or other
  modified_base (130)..(130): a, c, t, g, unknown or other
  modified_base (132)..(136): a, c, t, g, unknown or other
  modified_base (138)..(138): a, c, t, g, unknown or other
  modified_base (172)..(288): a, c, t, g, unknown or other
  modified_base (357)..(357): a, c, t, g, unknown or other
  modified_base (360)..(360): a, c, t, g, unknown or other
  modified_base (366)..(367): a, c, t, g, unknown or other
  modified_base (369)..(369): a, c, t, g, unknown or other
  modified_base (377)..(377): a, c, t, g, unknown or other
  modified_base (381)..(381): a, c, t, g, unknown or other
  modified_base (409)..(409): a, c, t, g, unknown or other
  modified_base (426)..(426): a, c, t, g, unknown or other
  modified_base (436)..(436): a, c, t, g, unknown or other
  modified_base (438)..(438): a, c, t, g, unknown or other
  modified_base (456)..(456): a, c, t, g, unknown or other
  modified_base (465)..(465): a, c, t, g, unknown or other
  modified_base (468)..(468): a, c, t, g, unknown or other
  modified_base (640)..(732): a, c, t, g, unknown or other
  modified_base (865)..(900): a, c, t, g, unknown or other
  modified_base (1117)..(1314): a, c, t, g, unknown or other
nnnnnnnnnnnnnnnnnnnnnnnnnnnnnngcgganatgtcgctggccgantttgggcgacgngaaattgtgctggccgaaaatgaaatgccggggctcatggcnatgcgggnnaantnnnntnnnnaanannnnntnaaaggtgcacggattgccggttgtttgcacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggattccggtttatgcgtggaagggcgaaaccgacgaggagtacgagtggtgcattgagcagaccctnatnttcccnnanggccagcnactnaacatgatcttggacgatggcggcgacntgaccaacatggtgcancacaagcatncngagctgctttctggcatntttgggctntcngaggagacaaccactggcgtacataatttggcaaaaatgctcgccgagggcaaactgatggtccccgcaatcaacgtgaacgactcggtcaccaagtccaagttcgacaacctctacggcattcgcgaatctcttcccgacggaatcaagcgagcaactgatgtaagtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatcgacccaatcaacgccctccaagcagcaatggagggctaccaggtgtgcacgctggaggaggtggcgccaattgcccaaatcatcgtgaccaccaccggctgcaaggacattgtccggggcgagcacnnnnnnnnnnnnnnnnnnnnnnnnnnnnnnnnnnnngtgggccacttcgactgcgagatcgacgtgaaatggctgaaccagaattgcaccagccgtgagcaagtgaagccccaagtggaccgctacctgctgaagaatggccgccatgtgattctgctggccgaggggcgacttgtcaatttgggctgtgccaccgggcactcctcctttgtgatgtccaccagcttcaccaaccaagtgcttgcccagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 216 - DNA, 1743 bp, Artificial Sequence
  Description of Artificial Sequence: Synthetic polynucleotide
  modified_base (1)..(270): a, c, t, g, unknown or other
  modified_base (508)..(1743): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaaaccgacgaagaacacgcctcccgcctggtcaagctgtttgacggcgaactggagctgaccaaggagtgcctgggccggaacccaaagtcctactccgtgtggcaccatcgcttcctgatggtcaagggccatcccagcatggatttgccggccgagttgagactgtgtgagcggggattgaccatggactgccgcaacttccattgctgggaccaccggcggtcggtcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 217 - DNA, 1542 bp, Artificial Sequence
  Description of Artificial Sequence: Synthetic polynucleotide
  modified_base (1)..(141): a, c, t, g, unknown or other
  modified_base (291)..(291): a, c, t, g, unknown or other
  modified_base (423)..(423): a, c, t, g, unknown or other
  modified_base (450)..(450): a, c, t, g, unknown or other
  modified_base (526)..(528): a, c, t, g, unknown or other
  modified_base (688)..(1266): a, c, t, g, unknown or other
  modified_base (1332)..(1332): a, c, t, g, unknown or other
  modified_base (1464)..(1464): a, c, t, g, unknown or other
  modified_base (1528)..(1542): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaacccagatccggacacaattaaaatgtttgtagggcaaataccaaagagttggaacgaagaaaaactggttgaatttttccaacagtatggacccgtttatcatttgaatattctgcgtgacaaagaaaccgacaatagccgagantgttgcttcgtaactttttatcacagaaaggatgctataaatgcgcagaatgaattgcataacatttatgtcatgcctggtctaagccatccagtccaaatgaaacctgcagatgttgaaagtcgtaatacncgcaagctttttgtgggcatgttgcgnaagatgatgaatgaagaggatatacgcaaattgttcattgaatttggtcaaattgaagattgcaacattttacgcnnngaaaatggaaaaagcagaggttgtgcttttttgacatttgtcaatcgttcatgtgctcaccaggctatcagaaaaatgaaccagtcacgaatttttgagggttgcacaaaaccaatggttgtaaagtttgcggacgcaggaaaagacaaaaatgcgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgggccggatggctgcaatcttttcatctatcatcttcctcaggaatttaccgattctgacctntattcgcttttctcttattttggttccatcttatcggccaaagttttcattgacaagcagaccaatctgagcaaatgtttcggatttgtttcatatggtgatgagggatcggcacagaacgcaatcaatagnatgaatggcttccaaatcggcaacaaaagattgaaggtccagttgaaacgctcggatgcaaatnnnnnnnnnnnnnnn

SEQ ID NO: 218 - DNA, 2964 bp, Artificial Sequence
  Description of Artificial Sequence: Synthetic polynucleotide
  modified_base (1)..(2076): a, c, t, g, unknown or other
  modified_base (2215)..(2334): a, c, t, g, unknown or other
  modified_base (2342)..(2342): a, c, t, g, unknown or other
  modified_base (2361)..(2361): a, c, t, g, unknown or other
  modified_base (2364)..(2364): a, c, t, g, unknown or other
  modified_base (2370)..(2370): a, c, t, g, unknown or other
  modified_base (2467)..(2467): a, c, t, g, unknown or other
  modified_base (2478)..(2479): a, c, t, g, unknown or other
  modified_base (2482)..(2486): a, c, t, g, unknown or other
  modified_base (2488)..(2493): a, c, t, g, unknown or other
  modified_base (2496)..(2497): a, c, t, g, unknown or other
  modified_base (2499)..(2499): a, c, t, g, unknown or other
  modified_base (2501)..(2502): a, c, t, g, unknown or other
  modified_base (2504)..(2505): a, c, t, g, unknown or other
  modified_base (2508)..(2510): a, c, t, g, unknown or other
  modified_base (2512)..(2513): a, c, t, g, unknown or other
  modified_base (2515)..(2519): a, c, t, g, unknown or other
  modified_base (2556)..(2556): a, c, t, g, unknown or other
  modified_base (2619)..(2619): a, c, t, g, unknown or other
  modified_base (2631)..(2631): a, c, t, g, unknown or other
  modified_base (2652)..(2652): a, c, t, g, unknown or other
  modified_base (2664)..(2664): a, c, t, g, unknown or other
  modified_base (2670)..(2670): a, c, t, g, unknown or other
  modified_base (2679)..(2680): a, c, t, g, unknown or other
  modified_base (2682)..(2682): a, c, t, g, unknown or other
  modified_base (2685)..(2685): a, c, t, g, unknown or other
  modified_base (2688)..(2688): a, c, t, g, unknown or other
  modified_base (2692)..(2692): a, c, t, g, unknown or other
  modified_base (2701)..(2702): a, c, t, g, unknown or other
  modified_base (2848)..(2964): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaattgctgggacaaggcggttttgcgcgagtttacaaagcactactaaacgaaggccgttcctatgcaattaagtatgaagctccaccttgcccctgggaagtttacatatgcgctacgctcaagcacagactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaagangaataatgcggaaatgggnggnctgctngcgacattttttgccattcaattgggcaaaatcctggaacaagttcacgcggctaatctcattcatggggatgtcaaaccggacaatgtgcttcttnctaccaggttnnatnnnnnannnnnnttnnantnntnnctnnncnnannnnnagcatcactcaaactgattgactggggccgttctatngatatgaagcaatattctggccaagaattcattggacgtgccggcacagcaaattttgattgngttgaaatgatntctggaatgccatggacttancaaacggatttntatggntttgttgcnncngtntangtgntgctcaagnntgaatatttgggattgaaaaggtaacatactgtttagattacctctaaaataagtgtttttagacggatggcaatgtacgatttgtggaatcagatctttgaggagttcctgaatattcccgattgcaagaacttgcccaactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 219 - DNA, 3618 bp, Artificial Sequence
  Description of Artificial Sequence: Synthetic polynucleotide
  modified_base (1)..(12): a, c, t, g, unknown or other
  modified_base (274)..(276): a, c, t, g, unknown or other
  modified_base (666)..(666): a, c, t, g, unknown or other
  modified_base (772)..(960): a, c, t, g, unknown or other
  modified_base (1306)..(1572): a, c, t, g, unknown or other
  modified_base (1816)..(1818): a, c, t, g, unknown or other
  modified_base (1981)..(2847): a, c, t, g, unknown or other
  modified_base (3127)..(3264): a, c, t, g, unknown or other
  modified_base (3441)..(3441): a, c, t, g, unknown or other
  modified_base (3475)..(3477): a, c, t, g, unknown or other
  modified_base (3613)..(3618): a, c, t, g, unknown or other
nnnnnnnnnnnnaagatcaacataactggatttcgaagctataaagatacgacaacagtccgaaatttttcaccaaaacataatgttgttgtgggaaggaatggcagtgggaaaagcaacttcttcaccgcaattcaattcattctatctacagaatacaccacattaagtcaacaggatcgacacgctcttttacacgaaggcattggaagcagatcacctttggctaaagtggaagttgtttttgacaatacggatcatcggatcccaacannngagagcgaagaagttcgaataatgcgccaagtgggaccaaagaaggatcaatatttcattgataataagcaagtgacacgaacagagattatcaacttaatggaatctgcggggttttcacgttcaaatccgtattatattgtcaaacaagggaaaatcacagaattggcaactgcttcggatgcttatcgtctcaaactgatcaaggaggttgctggcacccgtgtttttgatgaaaagaaagaagagagtaccaaaatcctccaggaaacacaagggaaaattgagaaaagtgttacattgctgggatatatcaatgaacggttgaagaaactggaggaagaaaaggaagatttgaaggagtaccagagatgggacaaaatgcgaagntcaattgagtacaccataaatgagaatgaaataaacgaagccaaaggtaaattggataagctcacgatccagcgtgaaaagataaacaaggagcagaatgaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacaaacaggaaatggccgaggcggaaatgaagcaattggagaaaacaattgccgataagcgtgcagaattgaaacagttggagccaaagcatcaaaagttgctggaagatgaaagtcgtctaaagtccgacattcgcattatgaaacaacgctgcaaagaactctatgcaaaacaaggccaccgcgaacaattccgaacaatagaggaacgagacaaacatttgaagaaagagatcaattggattgatcaccagatttccgaaacgcagaatcagctcgctgagatccagaactccattgaaaaggaatctgaagaagaccaagaattgcggaatcgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcaaggaaaacagcatcaactggtaaacggctattatggacgagtgatagatctcttcgattgcggcccgcaattcaataaagcaattgaagtgacagcagagtctcgtctgttcttccatgtggtcgaggatgatggcgttgcaatgaaaattctcgcacaaatcaatcaacgaggattgccaggagaagtgaacttttacccgctgaaccgtttgttggccgcagagaggcgcacagtgnnncaagacaaggatgccagtccaatgctggagcatatgaaatttgatgcaaaatttgagaaagtcttcgtcatcatgttcaaggaccatgccttcgtgaaagacttgaaagcgggctctcgcgtagcaaagaatgaaaacttcaactgtgtgacactcgaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataggctcgctgccttcggatgcgcatggcacttacgacaagatgagcttgaagcagctcgataagaagctgacggagtgcatgaatgagctgaagaaatacgagaatgtgaacaagaaggcgtgcgaacaatttatgcgagcgtcgagtcaaaaggaggaattgaacaatcgtgtcgaggacttgcagaagaacgagcaggccatcaaagacctcttaattgtgttggagaaccgtcgctacgaaacacttcatttaacattcaagcaagtggccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcattcaccggaaccactgaaactcgtgacattacctcactgtcgggcggtcagaaaaccctggttgcattggcactgatttttgccattcaaaagtgcgatccggcgcctttctatttgtttgatgagattgatgctgctttggaccaggaacatcgtcgggcagttgccganatttgccaaaacatttgtattttccccaactttnnntagaccacgttccgtgctgaactgcttgagcatgccgaaaagttctatggcgttcgtgtccgcgacaaagtcagctatattgatgagatcaccagagagagggcagtggactttgtccaggatgatcagacacacnnnnnn

SEQ ID NO: 220 - DNA, 555 bp, Artificial Sequence
  Description of Artificial Sequence: Synthetic polynucleotide
  modified_base (147)..(147): a, c, t, g, unknown or other
  modified_base (418)..(418): a, c, t, g, unknown or other
  modified_base (453)..(453): a, c, t, g, unknown or other
  modified_base (465)..(465): a, c, t, g, unknown or other
  modified_base (474)..(474): a, c, t, g, unknown or other
  modified_base (486)..(487): a, c, t, g, unknown or other
  modified_base (547)..(555): a, c, t, g, unknown or other
atggttatgctaacggttctcaaaaaggcgcgtcgaaaggagcaggaaatgagagtgctcatccttggcctggataattctggcaaaactacattcttgaagaaaattaatggagaagaaaccagcggaatagcgcctacattcgtntttaacataaaaacattggaatacaaaggctggaaattgaattgctgggatgttggcggacagaaaagtttgcgcacttactggaggaattacttcgagcgcacggatgccgtcatttgggtggtggacgcatgcgacacaacacgccttagtgattgccgcaaggaattgcactcgctgatcaacgaagagtgcatgcatggagtcactctgttggtgctggccaacaagcgggatctgaatggctctttcaatgctgaagcagttcaanagcttttacgcctggatcaaataaagaaacaccantggcggattttngagacaagngcatacacgggnntgaatattttagaagcattgggatggctttgccaggatgtgtcatcacgtgttttggtcnnnnnnnnn

SEQ ID NO: 221 - DNA, 2517 bp, Artificial Sequence
  Description of Artificial Sequence: Synthetic polynucleotide
  modified_base (21)..(21): a, c, t, g, unknown or other
  modified_base (57)..(57): a, c, t, g, unknown or other
  modified_base (108)..(108): a, c, t, g, unknown or other
  modified_base (144)..(144): a, c, t, g, unknown or other
  modified_base (219)..(219): a, c, t, g, unknown or other
  modified_base (261)..(261): a, c, t, g, unknown or other
  modified_base (285)..(285): a, c, t, g, unknown or other
  modified_base (297)..(297): a, c, t, g, unknown or other
  modified_base (303)..(303): a, c, t, g, unknown or other
  modified_base (321)..(321): a, c, t, g, unknown or other
  modified_base (372)..(372): a, c, t, g, unknown or other
  modified_base (384)..(384): a, c, t, g, unknown or other
  modified_base (426)..(426): a, c, t, g, unknown or other
  modified_base (447)..(447): a, c, t, g, unknown or other
  modified_base (489)..(489): a, c, t, g, unknown or other
  modified_base (513)..(513): a, c, t, g, unknown or other
  modified_base (525)..(525): a, c, t, g, unknown or other
  modified_base (531)..(531): a, c, t, g, unknown or other
  modified_base (549)..(549): a, c, t, g, unknown or other
  modified_base (600)..(600): a, c, t, g, unknown or other
  modified_base (612)..(612): a, c, t, g, unknown or other
  modified_base (654)..(654): a, c, t, g, unknown or other
  modified_base (675)..(675): a, c, t, g, unknown or other
  modified_base (717)..(717): a, c, t, g, unknown or other
  modified_base (741)..(741): a, c, t, g, unknown or other
  modified_base (753)..(753): a, c, t, g, unknown or other
  modified_base (759)..(759): a, c, t, g, unknown or other
  modified_base (777)..(777): a, c, t, g, unknown or other
  modified_base (828)..(828): a, c, t, g, unknown or other
  modified_base (840)..(840): a, c, t, g, unknown or other
  modified_base (882)..(882): a, c, t, g, unknown or other
  modified_base (903)..(903): a, c, t, g, unknown or other
  modified_base (945)..(945): a, c, t, g, unknown or other
  modified_base (969)..(969): a, c, t, g, unknown or other
  modified_base (981)..(981): a, c, t, g, unknown or other
  modified_base (987)..(987): a, c, t, g, unknown or other
  modified_base (1005)..(1005): a, c, t, g, unknown or other
  modified_base (1056)..(1056): a, c, t, g, unknown or other
  modified_base (1068)..(1068): a, c, t, g, unknown or other
  modified_base (1110)..(1110): a, c, t, g, unknown or other
  modified_base (1161)..(1161): a, c, t, g, unknown or other
  modified_base (1182)..(1182): a, c, t, g, unknown or other
  modified_base (1197)..(1197): a, c, t, g, unknown or other
  modified_base (1221)..(1221): a, c, t, g, unknown or other
  modified_base (1284)..(1284): a, c, t, g, unknown or other
  modified_base (1296)..(1296): a, c, t, g, unknown or other
  modified_base (1338)..(1338): a, c, t, g, unknown or other
  modified_base (1359)..(1359): a, c, t, g, unknown or other
  modified_base (1401)..(1401): a, c, t, g, unknown or other
  modified_base (1425)..(1425): a, c, t, g, unknown or other
  modified_base (1437)..(1437): a, c, t, g, unknown or other
  modified_base (1443)..(1443): a, c, t, g, unknown or other
  modified_base (1461)..(1461): a, c, t, g, unknown or other
  modified_base (1512)..(1512): a, c, t, g, unknown or other
  modified_base (1524)..(1524): a, c, t, g, unknown or other
  modified_base (1566)..(1566): a, c, t, g, unknown or other
  modified_base (1587)..(1587): a, c, t, g, unknown or other
  modified_base (1629)..(1629): a, c, t, g, unknown or other
  modified_base (1653)..(1653): a, c, t, g, unknown or other
  modified_base (1665)..(1665): a, c, t, g, unknown or other
  modified_base (1671)..(1671): a, c, t, g, unknown or other
  modified_base (1689)..(1689): a, c, t, g, unknown or other
  modified_base (1740)..(1740): a, c, t, g, unknown or other
  modified_base (1752)..(1752): a, c, t, g, unknown or other
  modified_base (1794)..(1794): a, c, t, g, unknown or other
  modified_base (1815)..(1815): a, c, t, g, unknown or other
  modified_base (1857)..(1857): a, c, t, g, unknown or other
  modified_base (1881)..(1881): a, c, t, g, unknown or other
  modified_base (1893)..(1893): a, c, t, g, unknown or other
  modified_base (1899)..(1899): a, c, t, g, unknown or other
  modified_base (1917)..(1917): a, c, t, g, unknown or other
  modified_base (1968)..(1968): a, c, t, g, unknown or other
  modified_base (1980)..(1980): a, c, t, g, unknown or other
  modified_base (2022)..(2022): a, c, t, g, unknown or other
  modified_base (2043)..(2043): a, c, t, g, unknown or other
  modified_base (2085)..(2085): a, c, t, g, unknown or other
  modified_base (2109)..(2109): a, c, t, g, unknown or other
  modified_base (2121)..(2121): a, c, t, g, unknown or other
  modified_base (2127)..(2127): a, c, t, g, unknown or other
  modified_base (2145)..(2145): a, c, t, g, unknown or other
  modified_base (2196)..(2196): a, c, t, g, unknown or other
  modified_base (2208)..(2208): a, c, t, g, unknown or other
  modified_base (2250)..(2250): a, c, t, g, unknown or other
  modified_base (2271)..(2271): a, c, t, g, unknown or other
  modified_base (2313)..(2313): a, c, t, g, unknown or other
  modified_base (2337)..(2337): a, c, t, g, unknown or other
  modified_base (2349)..(2349): a, c, t, g, unknown or other
  modified_base (2355)..(2355): a, c, t, g, unknown or other
  modified_base (2373)..(2373): a, c, t, g, unknown or other
  modified_base (2424)..(2424): a, c, t, g, unknown or other
  modified_base (2436)..(2436): a, c, t, g, unknown or other
  modified_base (2490)..(2490): a, c, t, g, unknown or other
  modified_base (2505)..(2505): a, c, t, g, unknown or other
  modified_base (2515)..(2517): a, c, t, g, unknown or other
atgcagatcttcgtgaaaacnctgaccggaaaaaccatcactctggaagtggaggcntcggacaccattgagaacgtcaaggccaagatccaggacaaggagggcatnccgccggaccagcagcgtctgatcttcgctggaaancaactggaagatggccgcactctggcggactacaacatccagaaggagtccactctgcacttggttttgcgcctncgcggaggaatgcagatcttcgtgaaaactctgaccggaaanaccatcactctggaagtggaggcntcggacaccatngagaangtcaaggccaagatccangacaaggagggcatcccgccggaccagcagcgtctgatcttcgctggaaancaactggaaganggccgcactctggcggactacaacatccagaaggagtccacnctgcacttggttttgcgcctncgcggaggaatgcagatcttcgtgaaaactctgaccggaaanaccatcactctggaagtggaggcntcggacaccatngagaangtcaaggccaagatccangacaaggagggcatcccgccggaccagcagcgtctgatcttcgctggaaancaactggaaganggccgcactctggcggactacaacatccagaaggagtccacnctgcacttggttttgcgcctncgcggaggaatgcagatcttcgtgaaaactctgaccggaaanaccatcactctggaagtggaggcntcggacaccatngagaangtcaaggccaagatccangacaaggagggcatcccgccggaccagcagcgtctgatcttcgctggaaancaactggaaganggccgcactctggcggactacaacatccagaaggagtccacnctgcacttggttttgcgcctncgcggaggaatgcagatcttcgtgaaaactctgaccggaaanaccatcactctggaagtggaggcntcggacaccatngagaangtcaaggccaagatccangacaaggagggcatcccgccggaccagcagcgtctgatcttcgctggaaancaactggaaganggccgcactctggcggactacaacatccagaaggagtccacnctgcacttggttttgcgcctgcgcggaggaatgcagatcttcgtgaaaacnctgaccggaaagaccatcacnctggaagtggaggcntcggacaccattgagaacgtcaangccaagatccaggacaaggagggcatcccgccggaccagcagcgtctgatcttcgctggaaancaactggaaganggccgcactctggcggactacaacatccagaaggagtccacnctgcacttggttttgcgcctncgcggaggaatgcagatcttcgtgaaaactctgaccggaaanaccatcactctggaagtggaggcntcggacaccatngagaangtcaaggccaagatccangacaaggagggcatcccgccggaccagcagcgtctgatcttcgctggaaancaactggaaganggccgcactctggcggactacaacatccagaaggagtccacnctgcacttggttttgcgcctncgcggaggaatgcagatcttcgtgaaaactctgaccggaaanaccatcactctggaagtggaggcntcggacaccatngagaangtcaaggccaagatccangacaaggagggcatcccgccggaccagcagcgtctgatcttcgctggaaancaactggaaganggccgcactctggcggactacaacatccagaaggagtccacnctgcacttggttttgcgcctncgcggaggaatgcagatcttcgtgaaaactctgaccggaaanaccatcactctggaagtggaggcntcggacaccatngagaangtcaaggccaagatccangacaaggagggcatcccgccggaccagcagcgtctgatcttcgctggaaancaactggaaganggccgcactctggcggactacaacatccagaaggagtccacnctgcacttggttttgcgcctncgcggaggaatgcagatcttcgtgaaaactctgaccggaaanaccatcactctggaagtggaggcntcggacaccatngagaangtcaaggccaagatccangacaaggagggcatcccgccggaccagcagcgtctgatcttcgctggaaancaactggaaganggccgcactctggcggactacaacatccagaaggagtccacnctgcacttggttttgcgcctncgcggaggaatgcagatcttcgtgaaaactctgaccggaaanaccatcactctggaagtggaggcntcggacaccatngagaangtcaaggccaagatccangacaaggagggcatcccgccggaccagcagcgtctgatcttcgctggaaancaactggaaganggccgcactctggcggactacaacatccagaaggagtccactctgcacttggtnttgcgcctgcgcggnggaaatattnnn

SEQ ID NO: 222 - DNA, 627 bp, Artificial Sequence
  Description of Artificial Sequence: Synthetic polynucleotide
  modified_base (202)..(204): a, c, t, g, unknown or other
  modified_base (206)..(208): a, c, t, g, unknown or other
  modified_base (228)..(228): a, c, t, g, unknown or other
  modified_base (259)..(259): a, c, t, g, unknown or other
  modified_base (261)..(262): a, c, t, g, unknown or other
  modified_base (300)..(300): a, c, t, g, unknown or other
  modified_base (321)..(321): a, c, t, g, unknown or other
  modified_base (477)..(477): a, c, t, g, unknown or other
  modified_base (480)..(480): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (607)..(627): a, c, t, g, unknown or other
atgggtatttctcaagacagctggcacaaacgccgaaagactggtgggaagcgcaacccaatccataagaagcgaaagtatgagctcggtcgtcctgctgcaaataccaagattggtccaaagcgaatccatttggtccgctgccgtggtggcaacataaagcatcgtgctctccgtcttgacactggcaactatgcctggnnntnnnaaggttgcactcgcaagacncgtgtcatcgacactgtctacaatgcttccnannacgaactggtgcgcaccaagactctcgtcaagggctcnatcatcaccatcgatgcggtnccattccgtcaatggtatgaggctcactacgcgcagccgcttgctcgcaagaagggccagaagctgaccgacgaggaggagcagcgcatccaacagaaacgctccaagaagacccagaagaagtacacggaacgtcagaagacggcagcggtgganccncatctgctggagcaattccagtctggccgnctnttggancgcatcagttcacgtccggggcagagtgggcgctgcgatggatacattcttgagggcaaggagctggagttctacctgaagaaggttnnnnnnnnnnnnnnnnnnnnn

SEQ ID NO: 223 - DNA, 681 bp, Artificial Sequence
  Description of Artificial Sequence: Synthetic polynucleotide
  modified_base (124)..(124): a, c, t, g, unknown or other
  modified_base (180)..(180): a, c, t, g, unknown or other
  modified_base (204)..(204): a, c, t, g, unknown or other
  modified_base (240)..(240): a, c, t, g, unknown or other
  modified_base (264)..(264): a, c, t, g, unknown or other
  modified_base (315)..(315): a, c, t, g, unknown or other
  modified_base (345)..(345): a, c, t, g, unknown or other
  modified_base (354)..(354): a, c, t, g, unknown or other
  modified_base (369)..(369): a, c, t, g, unknown or other
  modified_base (495)..(495): a, c, t, g, unknown or other
  modified_base (497)..(501): a, c, t, g, unknown or other
  modified_base (503)..(503): a, c, t, g, unknown or other
  modified_base (505)..(505): a, c, t, g, unknown or other
  modified_base (509)..(511): a, c, t, g, unknown or other
  modified_base (513)..(513): a, c, t, g, unknown or other
  modified_base (604)..(604): a, c, t, g, unknown or other
  modified_base (630)..(630): a, c, t, g, unknown or other
  modified_base (648)..(648): a, c, t, g, unknown or other
  modified_base (679)..(681): a, c, t, g, unknown or other
atgggcatctcggacaatgacgtgcaaaagcagttgcgccacatgatggccttcattgagcaggaggcgctggagaaagcggaggagattgacgccaaagcggaggaggagttcaacatggaanagggccgtctggtgcaacagcaacgccagaagatcatggagtactacgagaagaangagaagcaggttgagttgcagcgnaaaattcagcgctcaaacatgcaaaaccacggccgnctgcaatgcctgaaagcgcaggangagcatgtgaagcaggtgctggacgaggcgcgggccaatctgtccaaaatntcggccgacactcaccgctatccggccatnctgaagggnctcatcatgcagggncttttccaactgctcgagaaggaggtggtgctgcgttgccgctcccaggatgagcaactggtgaagcagctgctgccggaatgtttggaggagttgcagaagacttggggcaacacaaccaaggtntnnnnngncnacannncncccctgcccaaggacgcggccggcggtgtggaaatgtccgctcgggatggccgaatccgggtccgctccacgctggagtcccgtctggacntgatcgccgagcaaatcgtcccacanattcgcaccgcactgttngggccgaacccgaatcgcaaattctttgacnnn

SEQ ID NO: 224 - DNA, 1392 bp, Artificial Sequence
  Description of Artificial Sequence: Synthetic polynucleotide
  modified_base (9)..(9): a, c, t, g, unknown or other
  modified_base (312)..(312): a, c, t, g, unknown or other
  modified_base (318)..(318): a, c, t, g, unknown or other
  modified_base (340)..(340): a, c, t, g, unknown or other
  modified_base (351)..(351): a, c, t, g, unknown or other
  modified_base (564)..(564): a, c, t, g, unknown or other
  modified_base (567)..(567): a, c, t, g, unknown or other
  modified_base (621)..(621): a, c, t, g, unknown or other
  modified_base (627)..(627): a, c, t, g, unknown or other
  modified_base (631)..(631): a, c, t, g, unknown or other
  modified_base (633)..(634): a, c, t, g, unknown or other
  modified_base (636)..(636): a, c, t, g, unknown or other
  modified_base (639)..(641): a, c, t, g, unknown or other
  modified_base (644)..(645): a, c, t, g, unknown or other
  modified_base (651)..(651): a, c, t, g, unknown or other
  modified_base (741)..(742): a, c, t, g, unknown or other
  modified_base (774)..(774): a, c, t, g, unknown or other
  modified_base (837)..(837): a, c, t, g, unknown or other
  modified_base (1032)..(1032): a, c, t, g, unknown or other
  modified_base (1199)..(1199): a, c, t, g, unknown or other
  modified_base (1329)..(1329): a, c, t, g, unknown or other
  modified_base (1339)..(1341): a, c, t, g, unknown or other
  modified_base (1363)..(1392): a, c, t, g, unknown or other
atgggaaangaaaagatccatatcaacattgtggtcattggacacgtcgactccggtaaatccacgaccaccggtcacctcatctacaaatgcggtggcattgacaagcgaacaatcgagaaattcgagaaggaagcgcaggagatgggcaaaggctccttcaaatatgcttgggttctggacaaactgaaggccgagcgtgagcgtggtatcaccatcgacattgctctgtggaagtttgagacggccaagtactatgtgaccatcattgatgctcctggccatcgtgacttcatcaagaacatgatcacngatacntcccaagccgattgtgccgtgntggttgtcgcntgtggaactggtgaattcgaggccggtatctccaagaacggacaaactcgcgagcacgctctgcttgcccaaaccttgggcgtcaaacaactcatcgtcgcttgcaacaagatggacaccactgagccgccattctccgaggctcgctatgaggaagtgaagagcgaagtgtccaacttcatcaagaagatcggctacaacccggccaccgtngcnttcgtgccaatctccggcttcaacggcgacaacatgttggagccttcggacagnatgccntggntnnanggnnnggnnatcgancgcaaggaaggcaatgccagcggaaagaccttgttggaggcgcttgatgccatcgttccgcccagcagaccaactgacaagccactgcgnntgccactccaggacgtctacaagattggagcnattggaactgtgccggtcggccgtgttgagactggtgttctgaagcctggcatggtggtcacnttcgctccgcaaggcgtttccactgaagtcaagtccgtggaaatgcaccacgaggctctgcaagaggctgtgcctggcgacaacgtcggcttcaacgtcaagaacatctccgtcaaggacatccgccgtgggtcggtcgcttcggactccaagaatgacccggccaaggaggccaagcagttcactgctcaatcnatcatcatgaaccacccgggccaaatctctgctggctacactccagttctggactgtcacaccgcccacattgcctgcaagttcgccgagctcaaggagaaggtggatcgtcgtaccgggaagaaggtcgaggacagcccgaaggctctgaagtccggcgatgctgncatcatcgatctgatcccgaccaagccgctctgtgtggaggccttcactgactacgctccgctgggccgcttcgccgtccgtgacatgcgacagaccgtggccgtcggcgtgatcaaggctgtggagaangccgagggcnnnggaggcaaagtgaccaagtcgnnnnnnnnnnnnnnnnnnnnnnnnnnnnnn

SEQ ID NO: 225 - DNA, 2055 bp, Artificial Sequence
  Description of Artificial Sequence: Synthetic polynucleotide
  modified_base (1)..(36): a, c, t, g, unknown or other
  modified_base (271)..(271): a, c, t, g, unknown or other
  modified_base (287)..(288): a, c, t, g, unknown or other
  modified_base (313)..(314): a, c, t, g, unknown or other
  modified_base (348)..(348): a, c, t, g, unknown or other
  modified_base (543)..(543): a, c, t, g, unknown or other
  modified_base (649)..(649): a, c, t, g, unknown or other
  modified_base (915)..(915): a, c, t, g, unknown or other
  modified_base (924)..(924): a, c, t, g, unknown or other
  modified_base (933)..(933): a, c, t, g, unknown or other
  modified_base (952)..(952): a, c, t, g, unknown or other
  modified_base (984)..(984): a, c, t, g, unknown or other
  modified_base (993)..(993): a, c, t, g, unknown or other
  modified_base (996)..(996): a, c, t, g, unknown or other
  modified_base (1038)..(1038): a, c, t, g, unknown or other
  modified_base (1044)..(1044): a, c, t, g, unknown or other
  modified_base (1047)..(1047): a, c, t, g, unknown or other
  modified_base (1068)..(1068): a, c, t, g, unknown or other
  modified_base (1095)..(1095): a, c, t, g, unknown or other
  modified_base (1143)..(1143): a, c, t, g, unknown or other
  modified_base (1146)..(1146): a, c, t, g, unknown or other
  modified_base (1173)..(1173): a, c, t, g, unknown or other
  modified_base (1200)..(1200): a, c, t, g, unknown or other
  modified_base (1296)..(1296): a, c, t, g, unknown or other
  modified_base (1374)..(1374): a, c, t, g, unknown or other
  modified_base (1377)..(1377): a, c, t, g, unknown or other
  modified_base (1515)..(1515): a, c, t, g, unknown or other
  modified_base (1608)..(1608): a, c, t, g, unknown or other
  modified_base (1758)..(1758): a, c, t, g, unknown or other
  modified_base (1791)..(1791): a, c, t, g, unknown or other
  modified_base (1815)..(1815): a, c, t, g, unknown or other
  modified_base (1966)..(2055): a, c, t, g, unknown or other
nnnnnnnnnnnnnnnnnnnnnnnnnnnnnnnnnnnnggattcattgagaagcgcattcaactctttgaccaactgatgagggcctacaaagagcaagtcgcagcaaaagcagcagagccaatcaaagtgaagctgccagaaaacaaattggatgatgccttcgcttgggtgacaacgccgctctccattgcagaaaaagttacaaaaaagctgctcgaccgcttggtgattgccaaagtcaatggcgagctctgggatttggaccgaccantggaggcggattcccnnctggagttgctcacattcgatgacnncgaaggcaagcaagtcttctggcacagctcggcncacattcttggcgaggcttgcgagcgctactgcggctgccacctctgctatgggccgccaattcaggagggattctattacgacatgcacattgaggggaaaacaataaaccccgaggatttcaccaaactggaggccatcattggcacaattgtgaaggagcggcagccctttgagcggcttgaaatgagcaangaggatttgctccgcatgttcgactacaatccgttcaagcagcgcattatcaaagagaaggtgcagacgcccacaacaacagtctatcggtgtggaccgctgattnttttgtgccgaggcccgcatgtgcaaaccacgggcaaaattaaggcgattgcggtcacgaaggcatcctcctcctattgggaaggcaaagttgacaacgagcaactgcaacgagtgtatggcatttccttccccgacccgaaacaactgaaacaatggcgagtgctacaagaggagacagccagacgggaccatcgcaagttggggcgtgaccaggaactcttcatgttcaacccaatgtcgccgggatcggctttctggtacccnaaaggcgcncacatctanaacaccatggtcaacttcnttcgcacggagtacaggaagcgtggctttcangaggtgatnacnccgaacatctacaatgcaaagttgtgggaacagtcgggccantggcancantatgcggacaacatgttcganttcgaagttgagaaggaacaatttgcnttgaagccaatgaactgcccgggccattgcctgatgtttgaccacaanccncgttcctacaatgagctgcccattcgntttgccgactttggtgtgctgcatcgnaatgaactgagcggcgcactgactggcctcacacgcgttcgccgcttccaacaagacgatgcccacatcttctgccgcagcgatcagctcacacangagattctggcctgcctggacttcctcaacttcgtctacattgatgtgttcggattttccttcaaactgttcctcagnacncgtccagaaggctatcttggcgatttggaaagctggaacttggccgaaagtcagctgaaggaggcgttggatgccagcgggcacaaatgggagttgaatcccggggatggagcattctatgggccaaagattgacatncaaatcaaggacgccttgggccgctactggcaatgcgcaacactgcaacttgacttccagctgcctcaacgctttgacttgcactatttcgangagaacaaagagcgccatcgccccgtgatcatccaccgcgccatttttggctccctcgagcgcatgattgcaattctaacggaaaacttcgctggcaaatggcctttctggttgtctccgcgccaagcaaagatcatcgttgtgcacaantctgtcaaggagtacgcggcctctgttcgtgancgcattttccgggccggctttgangtggaatttgacgaggatagtccggacacgctgaacaagcggatcaggaatgcccagctggagcagttcaacttcattctggtcattggccaagtggagcagacgaatgggactgtgaatgtgcgcacacgggacaatcaggtttggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 226 - DNA, 2349 bp, Artificial Sequence
  Description of Artificial Sequence: Synthetic polynucleotide
  modified_base (1)..(366): a, c, t, g, unknown or other
  modified_base (550)..(555): a, c, t, g, unknown or other
  modified_base (777)..(777): a, c, t, g, unknown or other
  modified_base (781)..(783): a, c, t, g, unknown or other
  modified_base (984)..(984): a, c, t, g, unknown or other
  modified_base (1278)..(1278): a, c, t, g, unknown or other
  modified_base (1509)..(1509): a, c, t, g, unknown or other
  modified_base (2296)..(2349): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaaaaagttgcaattgttgctggcattgccctggcgctgaatttaatgttcaaccaattctcatacaaagagatctcttggaaggaattttattctgattttctggagaagcaaaatgtgggacggttggaagtttttgacaacagatgggtccatgttgtgcccaaagaacaatcgcagnnnnnntacaattactttttcaacattggaagtgtggaaagtttcgatcgcagtttggccgttgcccaacagcatttgggattggaaccggaacgccaagtgccggtcatgtacaaaagtgcaactgactggggccatttattaccacaactgctcaacatggttgtgccaatcatcattttcatctatttcttccgtatgatgcgagggggtggtccacaacaagcnaaannnaagggagggcgtggcggcttgcccggcatgttcaacccatttggccaatccactgctcgtgtgatcaacaaggaggacgtgaaaaccactttccgcgatgttgccggctgtgaggaggctaaaattgagatcatggaatttgtgaattttttgaaaaatccgcagcaatatcgggcattgggtgcgaaaattaccaaagtngcacttctcacggggccacccggaacagggaaaacgctgttggctaaggccacggcaggcgaagccaatgttccattcatcacagtctccggctcagaattcctggaaatgtttgttggtgttggcccaagccgagtgcgcgacatgttcgacatggcccgaaaacaatcgccatgcattctcttcattgatgaaatcgatgcaatcggccggaaacggggtggcaaaggctcaatcggaggacattccgaacaggagaatacgctcaatcagttgttggtggaaatggacgtnttttccacggacgagtctaatgtggtggtgattgcggccacaaatcgctcggatattctcgacccagcgttacttcgacccggccgttttgatcgccaaatatatattcccgtgccggatatcaagggaagagcgtccattttccgagtgcatttgcaacccataaagacctccttggacaaagtggagctttcgaggaagttggctgcgcacacaccaggcttttcagcngccgacattgccaatgtgtgcaacgaagcagcactgatcgctgccagagacgcccacgaggaagtgaccgcaaaagactttgagaaggccattgagcgcgtgattgcgggcatggagaagaaaagtcaagtgctacagccggatgagaagaagacagtggcgtaccatgaagctggtcatgcaattgccggatggtttctggagtttgccgaccctctgctaaaggtttccatcattccgcgtggcaaaggcctcggctatgcccagtacatgcccaaggaccagtatttatactccagagagcaattgatggaccggatttgcatgacactgggcggacgtgtggccgaggaaattttctttggacggatcacaaccggggcacaagatgacctgcaaaaagtcacacaaattgcatattcacagattgtaaaatttggaatgagcgagaaggttggccctctctcctttgacacaccacaacccggcgaaatggccttcgacaagccatattccgaagcgaccgcccaattgatcgaccaggaggtgcgtgatttggtgggcaacgctctccgccgtactcgagaacttctcatgtccaaagtggaacttatagaaaagattgcaatcagactgctcgaaaaggaggttctctcccgggaggacatgatcgaacttcttggcccacgaccattcgcagaaaagcacacatatgaagagtttgtggccggcactggtgggctggatgaggacacgtcactcccgaaaggtttttaatattttaacnnnnnnnnnnnnnnnnnnnnnnnnnnnnnnnnnnnnnnnnnnnnnnnnnnnnnn

SEQ ID NO: 227 - DNA, 1944 bp, Artificial Sequence
  Description of Artificial Sequence: Synthetic polynucleotide
  modified_base (1)..(66): a, c, t, g, unknown or other
  modified_base (238)..(291): a, c, t, g, unknown or other
  modified_base (972)..(972): a, c, t, g, unknown or other
  modified_base (976)..(976): a, c, t, g, unknown or other
  modified_base (978)..(978): a, c, t, g, unknown or other
  modified_base (1197)..(1197): a, c, t, g, unknown or other
  modified_base (1282)..(1944): a, c, t, g, unknown or other
nnnnnnnnnnnnnnnnnnnnnnnnnnnnnnnnnnnnnnnnnnnnnnnnnnnnnnnnnnnnnnnnnncgaaagtccaaggacgagtacaggaagcaaaaagatttggaggagcagcggaaagcaggcacagctccagctatggttgatattgaaactggccgtgacatcaaccctcacattccggaattcattgagaaaacaccatggtatataccacacagcggaccaactttgaaannnnnnnnnnnnnnnnnnnnnnnnnnnnnnnnnnnnnnnnnnnnnnnnnnnnnnttttatcagggcaccaccgaacgagttgcattcaaatatcgggacggcgcatgcgaaaattgtggtgcaatgggacacaagaaaaaggattgttttgagaaaccaaggcttgtcggcgccaaatggacaaattcgaacatagcagctgatgaccaccaaatgccaaaactggagttgggctgggatgccaaacgcgaccgctggaatggctacaacgcagatgactaccgctttgtggtgcaagaatttgagaaaatggacgagacgaggaaacttatcagagcagaacatttgaagattcaggaggatgaaaagaaaaattaggcagaaattgaagagaaggacgaagacatttacgctgaagatgcctctgcgcccggccaatctgttgacatggattcaagaactcgcatcactgtcaggaatttacgcatccgtgaagatacagccaaatacctttacaatctggacccgaatgcgccttattacgacccaaagagccgttcaatgcgtgagaatcctttcaagaatatgcctggaaaagaacaagaagcagcgcaatttgccggtgagaattttgtgcgtttttcgggtgaagttgccgaggcaaacgaggcccaaatatttgcatggcaagctcgttgcaaaggcattgatgtccactcgcttgctgaaccgacnagantngaagcgctgaaaagggaatttgagaagcaaaaggaggagaataaatcgagcgtgaagaatgaattgcttgaaaaatatggaggcgaagaacatcttaatgcaccgccaaaggaattattgttggctcaaacggaaaactacgtggagtacaatcggaagggcaaaataatcaagggggatgaacgaccggctgcgaaaagcagatacgaggaggatgtnttggtcaacaatcacacttccgtttggggctcatattggcgagatggtcgatggggatacgcatgttgccatcagttcctcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 228 - DNA, 1299 bp, Artificial Sequence
  Description of Artificial Sequence: Synthetic polynucleotide
  modified_base (301)..(363): a, c, t, g, unknown or other
  modified_base (831)..(832): a, c, t, g, unknown or other
  modified_base (834)..(834): a, c, t, g, unknown or other
  modified_base (838)..(842): a, c, t, g, unknown or other
  modified_base (845)..(847): a, c, t, g, unknown or other
  modified_base (849)..(856): a, c, t, g, unknown or other
  modified_base (858)..(864): a, c, t, g, unknown or other
  modified_base (868)..(868): a, c, t, g, unknown or other
  modified_base (870)..(870): a, c, t, g, unknown or other
  modified_base (873)..(874): a, c, t, g, unknown or other
  modified_base (876)..(876): a, c, t, g, unknown or other
  modified_base (940)..(940): a, c, t, g, unknown or other
  modified_base (942)..(944): a, c, t, g, unknown or other
  modified_base (949)..(949): a, c, t, g, unknown or other
  modified_base (996)..(996): a, c, t, g, unknown or other
  modified_base (1009)..(1009): a, c, t, g, unknown or other
  modified_base (1011)..(1011): a, c, t, g, unknown or other
  modified_base (1035)..(1035): a, c, t, g, unknown or other
  modified_base (1068)..(1068): a, c, t, g, unknown or other
  modified_base (1092)..(1092): a, c, t, g, unknown or other
  modified_base (1098)..(1098): a, c, t, g, unknown or other
  modified_base (1137)..(1137): a, c, t, g, unknown or other
  modified_base (1143)..(1143): a, c, t, g, unknown or other
  modified_base (1155)..(1155): a, c, t, g, unknown or other
  modified_base (1170)..(1170): a, c, t, g, unknown or other
  modified_base (1181)..(1182): a, c, t, g, unknown or other
  modified_base (1236)..(1236): a, c, t, g, unknown or other
  modified_base (1245)..(1245): a, c, t, g, unknown or other
  modified_base (1255)..(1255): a, c, t, g, unknown or other
  modified_base (1275)..(1275): a, c, t, g, unknown or other
  modified_base (1285)..(1299): a, c, t, g, unknown or other
atgactgattatgatctgactaaacgaatggttccgttcttcgatttgcatttggttattccacttcttgaatttatcgaaccaaagaaggtatatgatgaagaatccttcaagaaagcccatcttgcggtctaccgaaaaacgaatatggttgacaatctgatcaatgactacagcggtgatccactgctcaaggagtttcaggttaagaaagagcagattatcgaagagaaagagcggttgcgcgccgcttgtgatccagttctgtcaattttggatcgtgatgacgtgaaggaggttnnnnnnnnnnnnnnnnnnnnnnnnnnnnnnnnnnnnnnnnnnnnnnnnnnnnnnnnnnnnnnncagttcaaaaaggaaatgctggacagtctttacaaatacgcaaagttcctttacgaatgcggcaactacttggccgcctccgcttatttggagcactatcgaacactgattcctcagcatgatccgaactatttgaacgctctctatggcaaacttgcctccgaaatccttcttcagagttcggaccacgcccgagacgacttgaatcggcttagggcctacattgactcggatccattcgatagtgagctggagttgctgcaacaccgagcctggctactccattgggccctctatgtttgctgcaattacccaaagggccgcgatgacatcattgaattgttcctgaaccagcaacattacttgaacacaatccagatactttgtccacacttgctccgctatctggccgttgcggtgatcacaagcaaaagcaagcagaagagcagcctcaaggacttgatcaanntnattnnnnnggnnngnnnnnnnnannnnnnnccantnacnnantttctttcctgcctctacattgacttcgactttgaagcagcacagacaaagctgcaagagtgtnannnggtgntaagcaatgacctgttcctaacgcattgtttggacgaattccggganagcgcacgcctgntnatttttgagatgttctgccgaatncatcagtgcatcagcattgatatgttggccagncgattgaatatgcaaaaagcggangccgancgctggatagtcaatctgattcgcaactatcgaatcganggcgcnaaaatcgactcncaatcgggccaagtngtgatgagtgnnaaacccgtgagtatccacgagcaagtgatggaaaataccaagagaatggcgctncgttcccancagctggcantgcaattggaaaaacttcgnacggataaannnnnnnnnnnnnnn

SEQ ID NO: 229 - DNA, 1206 bp, Artificial Sequence
  Description of Artificial Sequence: Synthetic polynucleotide
  modified_base (366)..(366): a, c, t, g, unknown or other
  modified_base (475)..(477): a, c, t, g, unknown or other
  modified_base (735)..(736): a, c, t, g, unknown or other
  modified_base (738)..(741): a, c, t, g, unknown or other
  modified_base (744)..(746): a, c, t, g, unknown or other
  modified_base (804)..(804): a, c, t, g, unknown or other
  modified_base (816)..(816): a, c, t, g, unknown or other
  modified_base (852)..(852): a, c, t, g, unknown or other
  modified_base (885)..(885): a, c, t, g, unknown or other
  modified_base (897)..(897): a, c, t, g, unknown or other
  modified_base (948)..(948): a, c, t, g, unknown or other
  modified_base (990)..(990): a, c, t, g, unknown or other
  modified_base (1198)..(1206): a, c, t, g, unknown or other
atgtctcatcgaaaattctcggctcctcgtcatggttcaatggggttcacgccgaagaaacgttcaaaacgtcatcgcggcaaggtcaaggctttccccaaggatgatccgtcaaagcccattcacttgaccgctttcattgcttacaaggcgggaatgacgcacattgtgcgcgatgtggacaaactaggctcaaaagtgcacaagaaggaagttgttgaggccgtgaccattctcgaggccccacccatggtcattgttggcgttgtcggctacattgagacgccacgaggaccgcgtccactgaaagctgtgtttgctgaacatctgagcgaagactgcaagcgtcgcttctataagaacggncacaagagcaagaagaaggccttcaccaagtacgcgaagaagtggcaagacgagaagggccagaaggagattgagaaggacttggagaagatcaaaaagtactgctctnnngtgcgtgtcattgcacacactcagatgaagctgatgaagcatcgcaacaagaaggcgcacatcatggaaatccaagtgaacggcggcaccattcccgagaaagtcgactgggccaaggaacactttgagaagcaggtacccgtggaggaagtgttcgcgcaggacgagatgatcgactgcatcggagtgaccaagggcaaagggttcaagggagtgaccagccgttggcacacaaagaagttgccgcgtaaaacgcannannnnctnnncaaggttgcctgcattggcgcatggcatccatcgcgtgtgcaattcacggttgctcgngccggtcagaanggttaccaccatcggaccgaagtgaacaagaagatntaccgcattggcaagtcctgcttgacacccganggcaagaagaanggcaccaccgagaatgacatcacggccaagaccatcaacccaatgggcggnttcccgcactatggcttggtcaaccaagactttgtgatgatncgcggctgctgcattggctccaagaagcgtccaatcacgttgcgcaagagcctgatcacccaaaccaagcgctttgccttcgagaagatcgacctgaagttcattgataccagctccaagttcggccacggacgtttccagacaagcgccgagaagaagacattcatgggcaagaccaagaaggagctgcaggccgaaagtgcagcannnnnnnnn

SEQ ID NO: 230 - DNA, 1059 bp, Artificial Sequence
  Description of Artificial Sequence: Synthetic polynucleotide
  modified_base (1)..(162): a, c, t, g, unknown or other
  modified_base (249)..(249): a, c, t, g, unknown or other
  modified_base (600)..(600): a, c, t, g, unknown or other
  modified_base (621)..(621): a, c, t, g, unknown or other
  modified_base (644)..(644): a, c, t, g, unknown or other
  modified_base (651)..(651): a, c, t, g, unknown or other
  modified_base (657)..(658): a, c, t, g, unknown or other
  modified_base (663)..(666): a, c, t, g, unknown or other
  modified_base (711)..(711): a, c, t, g, unknown or other
  modified_base (814)..(816): a, c, t, g, unknown or other
  modified_base (838)..(840): a, c, t, g, unknown or other
  modified_base (1033)..(1059): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagccaacaaatggaccgatcgagagcgcgttctgctgctctgttcgcgcggctcgctggcacgaactcgccacctcgtcaatganttaaagcggctgatgcctcacacccattccgagtccaaatacgggaagaacggcaacatggatgatttgaacgagatgtgcgagctgtccaattgcaccaaatgcatttacttcgaaagccgcaaagggcgggatgtttacatgtgggcctccaatgtggatggcggaccttcggcaaaatttctggtaaaaaacatgcacacaatgacggagttgcacatgattgggaactgcttgaaaggctcccgaccaatcctctccttcgatccgaagtttgatgaggagccatatttgcgactgatcaaggagctttttgttaatactttcaaaacgcccaacttccatcctcgnagccagccattcattgaccangtgttcaactttgctgtctccanagatggnaatatnnggttnnnnaattaccagattgttgatggcaaggaggagcttcaggaaattgtncctcgctttgtgctccaaccaatccgcatcttcgatggctctttctgcggcactgtgctctacgacaacccagagtaccaaagccccaacctcatccgacggnnncacctgaaattccaaaaggccnnnttagagttgaagcagcgacaggagcaaaaggaggagcgcgcggtcaaggaggaaatggtgcgctccgtgaagctggacgacccaattggcgagattttcgacacggatcagagaatggaagaagaagcggatgaggacgagaagccggttgtgcgcaagaagaagaaagcagccaagctggtggagatgcaannnnnnnnnnnnnnnnnnnnnnnnnnn

SEQ ID NO: 231 - DNA, 1692 bp, Artificial Sequence
  Description of Artificial Sequence: Synthetic polynucleotide
  modified_base (1)..(15): a, c, t, g, unknown or other
  modified_base (147)..(147): a, c, t, g, unknown or other
  modified_base (152)..(152): a, c, t, g, unknown or other
  modified_base (180)..(180): a, c, t, g, unknown or other
  modified_base (186)..(186): a, c, t, g, unknown or other
  modified_base (193)..(480): a, c, t, g, unknown or other
  modified_base (796)..(1602): a, c, t, g, unknown or other
  modified_base (1690)..(1692): a, c, t, g, unknown or other
nnnnnnnnnnnnnnngtaaatgtacgggtggccacgatggacgcggagctggagttctgcattcagccatcgacgacgggcaagcagctgtttgaccaggtggtgaagacaatcaatctgcgcgagatctggtactttgggctccantacantgacaacaagggcttcccgtcgtggctnaaactnaacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttcaaaatgaacctcagcgagtgggagtcgcgcgtgatgtgctggtgggccgaccaccgcaccctgaaccgggaggccgccatgctggagtacctgaagattgcccaagacttggacatgtacggcatcaactacttcgccatccgcaacaagaagggcaccgaactgttcctgggcgtggacgccctcgggctgaacatctacgagaagaccgacaagctcaatcccaaagtgggcttcccctggtgcgaaatccgcaacatctccttcaacgacaagaagttcgtgatcaagccggtggacaagaagtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgccaaggcagggacaagtacaagacgctgcgccaaatccgctgcggcaacaccaaacggcgcattgaccagtacgagaacatgnnn

SEQ ID NO: 232 - DNA, 456 bp, Artificial Sequence
  Description of Artificial Sequence: Synthetic polynucleotide
  modified_base (1)..(18): a, c, t, g, unknown or other
  modified_base (33)..(33): a, c, t, g, unknown or other
  modified_base (36)..(36): a, c, t, g, unknown or other
  modified_base (42)..(42): a, c, t, g, unknown or other
  modified_base (45)..(45): a, c, t, g, unknown or other
  modified_base (57)..(57): a, c, t, g, unknown or other
  modified_base (60)..(60): a, c, t, g, unknown or other
  modified_base (72)..(72): a, c, t, g, unknown or other
  modified_base (75)..(75): a, c, t, g, unknown or other
  modified_base (78)..(78): a, c, t, g, unknown or other
  modified_base (81)..(82): a, c, t, g, unknown or other
  modified_base (90)..(90): a, c, t, g, unknown or other
  modified_base (93)..(94): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (126)..(127): a, c, t, g, unknown or other
  modified_base (129)..(129): a, c, t, g, unknown or other
  modified_base (133)..(135): a, c, t, g, unknown or other
  modified_base (140)..(140): a, c, t, g, unknown or other
  modified_base (144)..(145): a, c, t, g, unknown or other
  modified_base (147)..(147): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (183)..(183): a, c, t, g, unknown or other
  modified_base (187)..(187): a, c, t, g, unknown or other
  modified_base (195)..(196): a, c, t, g, unknown or other
  modified_base (201)..(201): a, c, t, g, unknown or other
  modified_base (210)..(210): a, c, t, g, unknown or other
  modified_base (219)..(219): a, c, t, g, unknown or other
  modified_base (414)..(414): a, c, t, g, unknown or other
  modified_base (454)..(456): a, c, t, g, unknown or other
nnnnnnnnnnnnnnnnnngctgacgcccaagancanaagaanaancgcactttccgnaanttcgtctaccgnggngtnganntggagcanttnntggagatgaangancancanttcaacaaactnntnccgnnncgtcnacgnngnaaaatgaancgnggnctnaancgnaancacaaatcnctgntggcccgnntgcgnaaggccaanttgaatgcnccggagctgatgaaaccggaatgcgtgaaaacccatctgcgtgacatgattgttttgccggaaatggttggctgcgttgttggcatccacagtgggaaagcatacaatcaggttgagattcgtgccgaaatgattggacactatttgggtgaattttcgatcacctacaagccagttaaacatggccgtccaganattggcgctacccacagttctcgcttcatccctctgaaannn

SEQ ID NO: 233 - DNA, 1968 bp, Artificial Sequence
  Description of Artificial Sequence: Synthetic polynucleotide
  modified_base (1)..(12): a, c, t, g, unknown or other
  modified_base (108)..(108): a, c, t, g, unknown or other
  modified_base (280)..(282): a, c, t, g, unknown or other
  modified_base (396)..(396): a, c, t, g, unknown or other
  modified_base (430)..(430): a, c, t, g, unknown or other
  modified_base (616)..(618): a, c, t, g, unknown or other
  modified_base (781)..(781): a, c, t, g, unknown or other
  modified_base (783)..(783): a, c, t, g, unknown or other
  modified_base (889)..(891): a, c, t, g, unknown or other
  modified_base (966)..(969): a, c, t, g, unknown or other
  modified_base (1005)..(1008): a, c, t, g, unknown or other
  modified_base (1010)..(1015): a, c, t, g, unknown or other
  modified_base (1018)..(1019): a, c, t, g, unknown or other
  modified_base (1021)..(1021): a, c, t, g, unknown or other
  modified_base (1023)..(1025): a, c, t, g, unknown or other
  modified_base (1035)..(1035): a, c, t, g, unknown or other
  modified_base (1144)..(1144): a, c, t, g, unknown or other
  modified_base (1453)..(1455): a, c, t, g, unknown or other
  modified_base (1536)..(1536): a, c, t, g, unknown or other
  modified_base (1636)..(1638): a, c, t, g, unknown or other
  modified_base (1654)..(1656): a, c, t, g, unknown or other
  modified_base (1966)..(1968): a, c, t, g, unknown or other
nnnnnnnnnnnngtttcacaccgtgaagaggattcaatgaatcaagaaccgtctatgagtgggcagcaaatagttggtctgatcattccacctcctgacatccgaaanattgtcgacaagaccgcgctttttgtcgcccgaaatggggccgaatttgagaacaaaatccgtgaacgtgaagcatccaatatgcgtttcaatttcctcaacccactggacccttatcatgcttactacaagaacaaagtcaaagaatacgagacgggcgttgcttcagcannnaaattacccgaagctgtccgtgaacacattcaaaaagctgagttcataccacggaatccgcctaaaccgttcgaattttctgccgatccttcaacaatcaatgcatttgatgtngacctcatccatttgacggcactttttgtggcanggaatggccgccaattcctgacgcaattgatgaatcgcgaagtgcgcaacttccaatttgactttctgaagccacaacattcaaatttccaatattttaccaaattggtcgagcaatacacaaaagtaattattccgccaaagaatgttgtcgatgaattgcgaaacactggcagccaccaaaagnnnatcctggaagatatccgctaccgagttggatgggagaaacatcaaaaagccatcaaggatcgtgaggatgctgaagttgagcaggagcgaatggcgtacaaccaaattgattggcacgactttgttgtcgtccaaactgtggactttcagccaactgagaccngnaatttaccgcctctttgcacaccaaaggatgttggggcacggattttgttgcaacaacgcacggaggcggcaaaagcagctgcagagagtgtggcgatggacatgnnngaatcggaatccgaggaagagccagaggagcacactggttcagctgttacgcaacctgcaccggctgccccaacnnnngctagcaatgttgtgatccgtgattatgatccgaannnngnnnnnntanncnannnaaagtcggcngagaaattcatcatttccccattgacaaatgagcgtgttcctgcggacaaattacacgagcatgttcgttacaatacagtggatccacaattcaaggaacagagagatngggaacaaatcgaacgccatgatgaagatcccatcacggcttcgggaaccgaaattagccgcaacattgcaaaactggctgaacgccgtactgatatctttggcattggcgccgaacaaaccataattggcaagaagttgggcgaggaggagcgcacaatgcgttcggatccaaaaacgatttgggacggccaacaggcaacaattgacgccaccactcgggctgcccagcaatcagtcagcttggagcagcaaatccaagaaatccaacgccaacatggctacattcaacagcagcagcaacaacaannnaacattcaaagaatgccggcaccccccaccacaattgctccaccgccgccggcaatggcaattccccaggttgcaaatganatgcctctccccatggggatgcgtcctccgccgggaatgccaggaatgccgcacggtggattcatgctcccgccacagccgatggacgatggtccaccannnagcaaaaggccacgtnnngaagaaactctggaaccggaaggccaatggttgcggaaggtgtcaggccaaatcactgtccggctgagcacgccacagaccgatgaatgggacctcaaaggccgaacattcgacattcaggaacagacgactgtgccggcgtccaaggcgaaacttgtttaccaggttcagtttaaatattggaggctcacaaataaaaaataaattaagggcattttcctgaaggacaacttcactctggcctactacaatttcacgcacaatgcgaatgtgcaattgatgctgaaagaacgtggaggaaagaagaagnnn

SEQ ID NO: 234 - DNA, 594 bp, Artificial Sequence
  Description of Artificial Sequence: Synthetic polynucleotide
  modified_base (1)..(9): a, c, t, g, unknown or other
  modified_base (178)..(180): a, c, t, g, unknown or other
  modified_base (190)..(195): a, c, t, g, unknown or other
  modified_base (235)..(594): a, c, t, g, unknown or other
nnnnnnnnngatgagatctgggacgacgccgaattgatcaagatgtatgaacagtcgactaagaaaatgcttcatcaccaattcgacgcgaggtttattcataaaataaaatcaccaaaatcattcatttatttttagtggaaagttggagacaagtgtatggccccttatgaagatnnnggccgattgnnnnnntatccggcaacgatcgattccattgatgagtccgaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 235 - DNA, 714 bp, Artificial Sequence
  Description of Artificial Sequence: Synthetic polynucleotide
  modified_base (1)..(225): a, c, t, g, unknown or other
  modified_base (454)..(459): a, c, t, g, unknown or other
  modified_base (706)..(714): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgaccttctgaaagagaagttcgaaaagctgaaacaggaaaatgaatcattatttgacaaatacagaagggcgttggcagaagccgaaaattcacgaaaaaggggcgaacgacaagtggaagaagccaaaatatttgccattcaaggattttgcaaagacctgttagaagtcgcagatgttcttaatatggccgtagaatctcttgaaaaggaagtcgccaaagatnnnnnngaaacgctgaagagcgtctacgaaggaataagcatgacaaaaaacacccttataaagacatttgcaaaacatgggctcgtacagatcaaccctgaaggacaaaaatttgaccctaacctgcatgaagctgtctttgaagtgccaggagatcagtcgaaacaaccacctggccatatctctcacgtgctgaacatcggttacagcttgcataaccgcccagtgagagctgcaaaagtgggtgttgtgnnnnnnnnn

SEQ ID NO: 236 - DNA, 951 bp, Artificial Sequence
  Description of Artificial Sequence: Synthetic polynucleotide
  modified_base (226)..(672): a, c, t, g, unknown or other
  modified_base (787)..(951): a, c, t, g, unknown or other
atgactgaacgcccatcgctcacctcaaaccatcagcgtctgcaggaaatgctgtgccatttgacgccccagaaggcgattgtgccctacaacatttgcttcgacgacgatggcaatttttgggttgcttccaagggtggcctgttcaagttcgattccaccgggaagaagctgctgtttgagcggaaagaattcccgaagaggatggccccgtacacacaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggggaagccctgctggtgatggacaaaaccgggcgattccaacggttcagcagggccggcaaattcctcggggtctccgccaaaattgacgatttcctcggcaatgggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 237 - DNA, 483 bp, Artificial Sequence
  Description of Artificial Sequence: Synthetic polynucleotide
  modified_base (1)..(3): a, c, t, g, unknown or other
  modified_base (91)..(91): a, c, t, g, unknown or other
  modified_base (93)..(95): a, c, t, g, unknown or other
  modified_base (98)..(99): a, c, t, g, unknown or other
  modified_base (102)..(102): a, c, t, g, unknown or other
  modified_base (346)..(483): a, c, t, g, unknown or other
nnnaccatctcaaagaacaacaaaatgatgcagcacctgaactacaagatgaaggttattgttcaggacaaccgcacgttcattggctacntnnnagnnttngacaagcacatgaacgtcattctttcggactgcgaggagctgcgccgagtcaaaccaaaggcgggcaaaaaggcagcggcggaggagaagcgcatccttggcctcgtgctccttcgtggcgacaaaatcatttcgatctcggtggagggcccgccccagcgtgaagactcgggcgcacaaattccacgggctggaggaatggctggaccgggacaggccaagggtgctgggcgtggagtgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 238 - DNA, 498 bp, Artificial Sequence
  Description of Artificial Sequence: Synthetic polynucleotide
  modified_base (39)..(39): a, c, t, g, unknown or other
  modified_base (294)..(294): a, c, t, g, unknown or other
  modified_base (402)..(402): a, c, t, g, unknown or other
  modified_base (496)..(498): a, c, t, g, unknown or other
atgccgccgaagttcgatccgaccgaagtcaagatcacntatctccgatgcgtcggtggcgaaattggagcaacatctgcccttgcgcccaaagttggtccgttgggattgtcacccaaaaagatcggtgaagacattgcgaaggcaactcaagactggaagggtctgaaagttacctgcaaacttacgatccaaaaccgcgttgccaaaattgacgtggtgccttctgcggcttctttgatcgtcaaggaactccgagagcctccgcgtgatcgcaagaaagtgaagaatggnaaacacaatggcaacttgaccattgagcaaatcatcaacatcgctcgccaaatgcgtcctcgctcgatggccaagaaattggagggaacggtcaaagagatccttggnactgcccaatcggtcggttgcaccgtcgacaaccaacatccgcacgacattgtggatgccattcgaaatggcgaattggagatcccggaggaannn

SEQ ID NO: 239 - DNA, 1638 bp, Artificial Sequence
  Description of Artificial Sequence: Synthetic polynucleotide
  modified_base (1)..(126): a, c, t, g, unknown or other
  modified_base (450)..(450): a, c, t, g, unknown or other
  modified_base (495)..(495): a, c, t, g, unknown or other
  modified_base (538)..(540): a, c, t, g, unknown or other
  modified_base (852)..(852): a, c, t, g, unknown or other
  modified_base (1030)..(1031): a, c, t, g, unknown or other
  modified_base (1114)..(1140): a, c, t, g, unknown or other
  modified_base (1288)..(1290): a, c, t, g, unknown or other
  modified_base (1489)..(1491): a, c, t, g, unknown or other
  modified_base (1519)..(1521): a, c, t, g, unknown or other
  modified_base (1636)..(1638): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaggccaagcgggcaagcagtgggacaaaccctcaaagtcggccatgaagaaggcggtgggccgttgggaagaggagaagcgcaaacgtgagaaggcgggcgagaaagcggccaaatcgcaggagaacaacgagaagcggctggaggacgcgaagaaggtacggcttgaacttgatgcctcgctgcccgcgccaacgaccgtgaaaatccgagattgcaaagagcagagtgggcaaagagtgaaagtgttcggatttgtgcacaggattcggcagcaaggcaaagacctgacttttgtggtgctccgcgatggcaccggnttcttgcagtgcgtgttcaccggcaaactctgtcaaacctatgangcgttgacgctcagcaccgagagctcggtttgcgtctatggannngtcaaccaactgcccgaagggaagaccgccccgggcgggatcgagctggtcgccgaccactgggcactcatccatggcgcccctcccggcggggtcgacaatgtgctgaacgtggaggccaacgtggacgtgaagctggacaaccggcatttggtgattcggggcgaaaatgcggcggccattttgcgcattcgggcggccgtgacgcgcgcaatgcgggagcacttccacgcgaagaagtacaccgaggtgtttccgcccacgctggtgcagacccaggttgaaggcggctccaccctgttcggactgganttcttcggcgagcccgcctacctgacccagtcctcgcaactctacctggaaacctgcattgcctcgctgggcgacgtcttctgcactgcgcagtcctaccgggcggagaagtcacggacccggcgccatttggccgagtacacccatgtggagggcgaattcccgttcatcacttttnnagaattaatggaccgcatagaggacttggtttgcgacaccgtggaccgggtgatggccgatccggacatcaaggagctcattnnnnnnnnnnnnnnnnnnnnnnnnnnnccaaagcgcccattcctgcgcatgacctacggggaggcaattgaatggctccaaaagcatggggtcaacaacgaggagggcaaaccgttccagtttggggaggacatccctgaggggcccgagcgtcaaatgaccgacacgattggannnccaattctgctgaaccgcttccctgcgggcatcaaagccttctacatgtcccgctgtgcggacgcccctgaactgaccgaatcggtggatttgctgatgcccggggtgggcgagattgtgggcggctcaatgaggatttggaaggagcaagagctgatggatgcgttcaagaagaccgacattgaccccaagcattatnnntggtacgtggaccagcgcaaatacggcnnnctgccccatggcggtttcggccttggcctggaacgctttgtctgctggctggccaaccagcaccacatccgcgacgtttgcctctacccgcgctacattggccgatgcgctcctnnn

SEQ ID NO: 240 - DNA, 984 bp, Artificial Sequence
  Description of Artificial Sequence: Synthetic polynucleotide
  modified_base (1)..(87): a, c, t, g, unknown or other
  modified_base (292)..(312): a, c, t, g, unknown or other
  modified_base (442)..(444): a, c, t, g, unknown or other
  modified_base (556)..(984): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnggacgcccggattggtggaccgaacacggctatcaggatatattgaaacgcaagggagtcaacacaggaatgcgccaaacacttcgagaaaaagacaaatactggtgggatccaaaagttccggacggcacctcggttattggcccatttgggttggattcgcaatggcacaaaaacactcggatcaaagccgatcagccaggtnnnnnnnnnnnnnnnnnnnnnaaggtgatgaaaagcacggcccaatacaagaacatgatcagcaaatttgagctgagcaaggagcatcccggaattgcggtcaacgtgacactagacaaaatgaacaacgtggactacagaaatattggcnnnggattggcgatgggccgaatccgctaccacgtgggaccccgcttttgggacaaacccctgaacgagggatgcattgagaagggccttggattggccaaattgatggcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 241 - DNA, 342 bp, Artificial Sequence
  Description of Artificial Sequence: Synthetic polynucleotide
  modified_base (1)..(9): a, c, t, g, unknown or other
  modified_base (213)..(213): a, c, t, g, unknown or other
  modified_base (340)..(342): a, c, t, g, unknown or other
nnnnnnnnngaggttgttgacgcattgagcaagctgtatgtggactatcaacggactacaccaaaacgcctcaagatcatcgatgcctacatgctttacatcctcatcacgggcattctgcagttcgtctactgtctgatggttggcacttttcctttcaacgcattcctggccggcttcatttcctgtgttgccagttttgtgcttgcccanaacctccgtatccaagtgaatgcggagaacaaatccgaattccccggcatcagccccgaacgcgcctttgctgactttattttcgcgcatgtgattctgcacctggttgtgatgaactttattggcnnn

SEQ ID NO: 242 - DNA, 1617 bp, Artificial Sequence
  Description of Artificial Sequence: Synthetic polynucleotide
  modified_base (1)..(63): a, c, t, g, unknown or other
  modified_base (262)..(262): a, c, t, g, unknown or other
  modified_base (601)..(601): a, c, t, g, unknown or other
  modified_base (603)..(604): a, c, t, g, unknown or other
  modified_base (606)..(606): a, c, t, g, unknown or other
  modified_base (763)..(765): a, c, t, g, unknown or other
  modified_base (801)..(801): a, c, t, g, unknown or other
  modified_base (813)..(813): a, c, t, g, unknown or other
  modified_base (837)..(837): a, c, t, g, unknown or other
  modified_base (894)..(895): a, c, t, g, unknown or other
  modified_base (924)..(924): a, c, t, g, unknown or other
  modified_base (1132)..(1134): a, c, t, g, unknown or other
  modified_base (1189)..(1189): a, c, t, g, unknown or other
  modified_base (1191)..(1195): a, c, t, g, unknown or other
  modified_base (1197)..(1204): a, c, t, g, unknown or other
  modified_base (1206)..(1209): a, c, t, g, unknown or other
  modified_base (1211)..(1219): a, c, t, g, unknown or other
  modified_base (1221)..(1221): a, c, t, g, unknown or other
  modified_base (1223)..(1223): a, c, t, g, unknown or other
  modified_base (1227)..(1227): a, c, t, g, unknown or other
  modified_base (1230)..(1231): a, c, t, g, unknown or other
  modified_base (1233)..(1237): a, c, t, g, unknown or other
  modified_base (1242)..(1242): a, c, t, g, unknown or other
  modified_base (1416)..(1416): a, c, t, g, unknown or other
  modified_base (1425)..(1425): a, c, t, g, unknown or other
  modified_base (1428)..(1428): a, c, t, g, unknown or other
  modified_base (1431)..(1431): a, c, t, g, unknown or other
  modified_base (1533)..(1533): a, c, t, g, unknown or other
  modified_base (1590)..(1590): a, c, t, g, unknown or other
  modified_base (1593)..(1593): a, c, t, g, unknown or other
  modified_base (1597)..(1597): a, c, t, g, unknown or other
  modified_base (1612)..(1617): a, c, t, g, unknown or other
nnnnnnnnnnnnnnnnnnnnnnnnnnnnnnnnnnnnnnnnnnnnnnnnnnnnnnnnnnnnnnntcattgacaacatccgcgcgtctttcggcctcgagcgcagaagtgtcccgaattctggaggagaaaatccttggccaagaaacgaagatcaatctggaagaaaccggccgcgtcctgtccatcggtgacggcattgcccgcgtgtatggcctgaagaacatccaagccgaggagatggtggaatttgactcgggaatgnagggaatggccctgaacttggagcccgacaacgtcggcgtggtcgtgttcggcaacgacaaggtgatcaaggagggcgacgtggtcaagcgcacgggatccattgtggacgttggcgtcggcgaggagctgcttggccgtgtggtggacgccctgggcaacccaatcgacggcaagggcccaatcaaagtgagccagcgatcgcgggtggaggtgaaggcgccgggcatcatcccgcgggtgggagtgcgcgaacccatgctgactggcgtcaaggccgtggactcactggtgcccattggacgtggccaacgcgagctgatcattggggaccgtcagncnngnaaaaccgcaatcgccatcgataccatcatcaaccagaagcgcttcaacaccagtgccgaagagaagaagaagctgtactgcatctatgtggccatcgggcagaagcgttccaccgttgcgcagattgtgaagcgactcaccgatgcggatgccatgnnntacacgatcattgtgtcggcgacggcctcggacgcngcccctctccanttcctggccccctactcgggcgcngccatgggcgagttcttccgcgacaacggcaaacacgcgctgatcatctacgacganntgtccaagcaggcggtggcctaccgccanatgtccctgctgctgcgccgtcccccagggcgtgaggcctatccaggtgacgtcttctacctgcactcgcgtctgctcgagcgtgccgccaagatgaacgagacccacaagggcggctccatgaccgcgctgcccatcatcgagacccaagcgggagacgtgtccgcctacatccccaccaatgtgatttccatcacggacggccaannnttcctggagaccgagctcttctacaagggtgtccgcccggcaatcaacgtggggntnnnnntnnnnnnnntnnnntnnnnnnnnnanancaantcnntnnnnnaggtngccggctccatgaagctcgagctggcccagtaccgtgaggtggccgccttcgcccagttcggctctgacctggacgcctccacccaacagctgctcaaccgcggtgtgcgcctcaccgagctgctaaaacagggccaatacgtgccgatggccatcgaggagcaggtggccgtnatctacgcnggngtnaagggctacctggacaagattgacccctcccaaatcaccaccttcgagcgcgagtacctggcccacatccgtgcccatgagcaggagctgctgaagacaatncgcgaggagggccagatcacgaccagcacggatgacaagctgaagaagttggtgcanacnttcntggcgcagttcaagnnnnnn

SEQ ID NO: 243 - DNA, 2619 bp, Artificial Sequence
  Description of Artificial Sequence: Synthetic polynucleotide
  modified_base (1)..(840): a, c, t, g, unknown or other
  modified_base (940)..(942): a, c, t, g, unknown or other
  modified_base (1137)..(1137): a, c, t, g, unknown or other
  modified_base (1140)..(1145): a, c, t, g, unknown or other
  modified_base (1148)..(1154): a, c, t, g, unknown or other
  modified_base (1156)..(1157): a, c, t, g, unknown or other
  modified_base (1159)..(1168): a, c, t, g, unknown or other
  modified_base (1329)..(1329): a, c, t, g, unknown or other
  modified_base (1551)..(1551): a, c, t, g, unknown or other
  modified_base (1711)..(2217): a, c, t, g, unknown or other
  modified_base (2353)..(2355): a, c, t, g, unknown or other
  modified_base (2403)..(2403): a, c, t, g, unknown or other
  modified_base (2413)..(2413): a, c, t, g, unknown or other
  modified_base (2454)..(2454): a, c, t, g, unknown or other
  modified_base (2484)..(2484): a, c, t, g, unknown or other
  modified_base (2523)..(2523): a, c, t, g, unknown or other
  modified_base (2572)..(2619): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtttctacgcaatcttccatacagttgtacagaggagaaactgaacaatttattcaatccatttgggcccttggcagaagttgagtgcataattgacnnncgaagcggacaatgcaaaggttttgcgcttatcacattcatgttccctgaacatgctttggaggcatggcaatcattggatggaaaaatattcatgggtcgaatgttgcatataatagccggtgaagagaagtgaaaaagacggatgggaatgaagcaaaagctttatcatcattccaacgagaacgacaacaanacnnnnnngannnnnnnannannnnnnnnnncattccaacgagaacgacaacaaaacctgaaagagaatgcaagcaaaacgcaacacacttggaattcacttttcctcggcacaaatgcaatagcggagaatttggcagaaagttacgagatcgagaagaggcacttgctattggaccagggcgaaagcagngccgccgttcggatggcaatggccgagacaagacttgtccgcgaaacacgcaaattccttttggggcaaggcataaaattggacgctttttcgcagtcacaacaaaagcgatcaaaaaccgtgattttggtgaaaaaatttgaatggaaagccgaaagcgaacggctccgacaattcttcgcacgattcggacaagtcaaaaatgtcattatgccaccatancatgggatatctgcattggtggagatggagagtgaattggaagccaaaaacgcatttgaagcgttagcctatacaaagacaaacggacaaccgctttatttggaatgggcaccaatcgatgtttttgatgaagaacatccgtcaagatcaaagcgtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaataaaaaggaaccggagcgcacaaaaatcctcgtacgaaatgtgccctttcaggcaaatttaaaggagattacacaacttttctcggcatttggagaactcaagtttgtgcgaatgccaaaaaagcctggcnnnggcgaaggccatcgtggtttctgttttgtggatttcctttcagttggngatgcacgcngagcaatggagtccttggcacattccacacatttgtatggnagacgattagtgcttgaatgggcaaaacangaagaaactatggaggaattgaggagcaaaaccaaacgnaaagaccaaggcagaaaacacggtggaaagaaatcaaagatgcgatctnnnnnnnnnnnnnnnnnnnnnnnnnnnnnnnnnnnnnnnnnnnnnnnn

SEQ ID NO: 244 - DNA, 1245 bp, Artificial Sequence
  Description of Artificial Sequence: Synthetic polynucleotide
  modified_base (1)..(90): a, c, t, g, unknown or other
  modified_base (312)..(312): a, c, t, g, unknown or other
  modified_base (679)..(681): a, c, t, g, unknown or other
  modified_base (717)..(717): a, c, t, g, unknown or other
  modified_base (1243)..(1245): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatcgatgaagatgattatctgaagctccaaaaattggaaaataaattggctcatttggatgttatggaagagtacctcaaattggatatgcgtactcttgaaaaggaattggtgcatgcacaagaggaagtcaagcgtattcaatctgttccactgattattggccaatttcttgaagcggtcgactatgatcatgcgattgttggttctactacagantccaattattatgttcgcgttctttcaattcttgatcgagaacttatgaagccgggatgcagtgtttcactccacaaatattccaatgctcttgttgatgtgctcccgccggagtcagattcttctattcaaatgctacgtccagatgagaagccggatatttcatatgccgatgtgggcggattggacacacaaaaacaagaagtccgggaagcagtggagctcccattgaccaatggcgaactttatgaacagatcgggattgatcctccacgcggtgtgcttctttatggtcctcctggatgtggtaagaccatgcttgcgaaggcagtcgctcaccatacaaaagcatcattcattcgtgttnnnggcagcgagtttgtgcagaaatacttgggtgaagtncctcgcatggtgcgtgatgttttccgtttggctaaagagaatagtccgtgcattatcttcatcgatgagattgatgcaatcgctacaaaacgttttgacgcgcaaactggagcagaccgtgaagttcagcggattttacttgagctattgaaccaaatggatggatttgaccagagcaccaatgtcaaggtcattatggcaactaatcgccaagatacgctcgatcccgctcttctacgacctgggcgattggacaggaagatcgaattcccaatgcctgatcgccggcagaaacgaatggttttctctacggttactgcaaagatgaacctgagtgacgaaattgaccttgaagactacgtttcccgtcctgataaaatatcttgtgccgaaatttcttccatctgtcaagaggctggcatgtacgcagtccgagagaaccgttatatggtgctgaacaaggacttcaataaagcctacaaacaggtcgtgaagaaggacagcgatgaatttgacttttacaaannn

SEQ ID NO: 245 - DNA, 1410 bp, Artificial Sequence
  Description of Artificial Sequence: Synthetic polynucleotide
  modified_base (1)..(6): a, c, t, g, unknown or other
  modified_base (132)..(132): a, c, t, g, unknown or other
  modified_base (307)..(324): a, c, t, g, unknown or other
  modified_base (691)..(691): a, c, t, g, unknown or other
  modified_base (693)..(694): a, c, t, g, unknown or other
  modified_base (696)..(696): a, c, t, g, unknown or other
  modified_base (699)..(699): a, c, t, g, unknown or other
  modified_base (856)..(1056): a, c, t, g, unknown or other
  modified_base (1062)..(1062): a, c, t, g, unknown or other
  modified_base (1071)..(1071): a, c, t, g, unknown or other
  modified_base (1092)..(1092): a, c, t, g, unknown or other
  modified_base (1125)..(1125): a, c, t, g, unknown or other
  modified_base (1141)..(1141): a, c, t, g, unknown or other
  modified_base (1143)..(1143): a, c, t, g, unknown or other
  modified_base (1188)..(1188): a, c, t, g, unknown or other
  modified_base (1239)..(1239): a, c, t, g, unknown or other
  modified_base (1263)..(1263): a, c, t, g, unknown or other
  modified_base (1281)..(1281): a, c, t, g, unknown or other
  modified_base (1293)..(1293): a, c, t, g, unknown or other
  modified_base (1393)..(1410): a, c, t, g, unknown or other
nnnnnngatgagaaggcagcggatgactcacaaccatggctgatgaagcaggacttgtccacgctggatcccgccaaacttgatccattaactgaggaagtgatcagccgtcaagccacaataaatataganacaattggccatgtcgcccacggcaagtccaccctggttaaggcgatttccggagtgcacaccgtgaagttcaagaacgagctggagcgcaacatcacaatcaagctgggctatgccaacgcgaaaatctatcggtgcaacaatccggactgtccgcgtccacattgctacaggnnnnnnnnnnnnnnnnnncccgaccgcattccctgtgatcgaccaaactgtgggggcgagtacgtgtgcgtgcgccatgtctcctttgtggactgtccggggcacgacattctcatggccaccatgttgaacggtgctgctgttatggacgcagccatgctgctgattgccggcaacgagccctgtccacagccccaaacctcggagcacttggccgccgtggaaatcatgaagctgaagcatttgctgatcctgcagaacaagattgacctgatcaacgagaaccaagcaaaggaccagcacgaccagatcaagaactttgtggagggcaccgtcgcagacgcggcccccatcattcccatctccgcacaactcaagtacaacntnnangtnctctgcgaatatctgtgcaaaaaggtgcccgtcccagtccgtgatttcacttcgcccgcccgtctcattgtggtccgctcctttgacgtgaacaagcccggctcggaggtggagcagctgaagggcggtgtggctgggggctccattctgaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcggncacgtgctnggtgcggtcggcacactgccngacatctacacggacattgagatttcctaccanttgctgcgccgtctgntnggggtgcgcacggaggcgggcaaaaagggcgcaaaagtggcgaanctgaccaagggcgaggtgctgatggtcaacattgggtcgctctccaccggnggacgcgtgattgccgttaaaggngaagccgccaaaatcacnctgaccgacccnatctgcacggaggacaaccagaacattgcgctcagccgccgcatcgagaagcattggcgcctgattggatggggcacaatccgacggggcaccaccattnnnnnnnnnnnnnnnnnn

SEQ ID NO: 246 - DNA, 1089 bp, Artificial Sequence
  Description of Artificial Sequence: Synthetic polynucleotide
  modified_base (1)..(114): a, c, t, g, unknown or other
  modified_base (135)..(137): a, c, t, g, unknown or other
  modified_base (139)..(140): a, c, t, g, unknown or other
  modified_base (142)..(142): a, c, t, g, unknown or other
  modified_base (265)..(265): a, c, t, g, unknown or other
  modified_base (267)..(267): a, c, t, g, unknown or other
  modified_base (630)..(630): a, c, t, g, unknown or other
  modified_base (891)..(891): a, c, t, g, unknown or other
  modified_base (943)..(1089): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggttgtggtccacccnnntnntntgctcagtgttgtggatcacttcaatcgcattcataagagccaaaaagttaagcgagttgttggtgttctgctgggcagcatgaagtttgacaaatcgctggacattgcgaattgttttgccntnccttatgatgaagattccgaggatccgagcattttcttcttggatgccgactatctcgaagacatgttcggcatgttctacaaagttgcagcgcgagagaaaatcattggttggtaccacacaggacccagactttgcaagaacgacattgacatcaacaaggtgatgaagcgttttacgccaaatcccgttttggtcatcatccaagcagcacagggcaacttggctttgccaacggatgcttatgtggaagttcaagaagttcacgatgatggaacgcccccaatcagcacctttgagcacgtccccagtgaaattggagcggaagaggctgaggaggtgggagtggagcatctcataggngacatcaagaatcagacagctggaacactctctcaacggatcaccaaccaactgatgggtcttcgcggcttccaaagtcacttggccggcgcaaccagttacttgcatcgtgtcgcaaaacgtgaactgccctacaatcaggcaatcattgaccaaattcaggaaatgcggaatctgctgccggatgtgatggaagccgaactggtggatacccagaacataatggccaacgatcatcaaatgtgcatctacttgggcaanttggtgcgcactgtcattgctttgcacaacttgattgacaacaaagtatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 247 - DNA, 1998 bp, Artificial Sequence
  Description of Artificial Sequence: Synthetic polynucleotide
  modified_base (1)..(120): a, c, t, g, unknown or other
  modified_base (147)..(147): a, c, t, g, unknown or other
  modified_base (175)..(175): a, c, t, g, unknown or other
  modified_base (186)..(186): a, c, t, g, unknown or other
  modified_base (207)..(207): a, c, t, g, unknown or other
  modified_base (222)..(222): a, c, t, g, unknown or other
  modified_base (228)..(228): a, c, t, g, unknown or other
  modified_base (237)..(237): a, c, t, g, unknown or other
  modified_base (261)..(261): a, c, t, g, unknown or other
  modified_base (280)..(555): a, c, t, g, unknown or other
  modified_base (652)..(729): a, c, t, g, unknown or other
  modified_base (759)..(759): a, c, t, g, unknown or other
  modified_base (762)..(762): a, c, t, g, unknown or other
  modified_base (780)..(780): a, c, t, g, unknown or other
  modified_base (789)..(789): a, c, t, g, unknown or other
  modified_base (792)..(792): a, c, t, g, unknown or other
  modified_base (825)..(825): a, c, t, g, unknown or other
  modified_base (834)..(834): a, c, t, g, unknown or other
  modified_base (855)..(855): a, c, t, g, unknown or other
  modified_base (869)..(869): a, c, t, g, unknown or other
  modified_base (879)..(879): a, c, t, g, unknown or other
  modified_base (897)..(897): a, c, t, g, unknown or other
  modified_base (904)..(906): a, c, t, g, unknown or other
  modified_base (915)..(915): a, c, t, g, unknown or other
  modified_base (918)..(918): a, c, t, g, unknown or other
  modified_base (930)..(930): a, c, t, g, unknown or other
  modified_base (945)..(945): a, c, t, g, unknown or other
  modified_base (948)..(948): a, c, t, g, unknown or other
  modified_base (954)..(954): a, c, t, g, unknown or other
  modified_base (1099)..(1099): a, c, t, g, unknown or other
  modified_base (1149)..(1149): a, c, t, g, unknown or other
  modified_base (1203)..(1203): a, c, t, g, unknown or other
  modified_base (1335)..(1335): a, c, t, g, unknown or other
  modified_base (1362)..(1362): a, c, t, g, unknown or other
  modified_base (1371)..(1371): a, c, t, g, unknown or other
  modified_base (1374)..(1374): a, c, t, g, unknown or other
  modified_base (1477)..(1998): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccagacattcatggcctggaccgancaagaccagacggatttttgcaagcacntgctgcagagnatgtgccaccatcagcatggncaaattgaccaattnctgggnccaatgctncaacgggatttcatcagcctgctnccaagtcagagtttgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccagcggactctacccccaaatcatcaaggacattcaacaaattgaacagaactggcgcgaagggcggcaccggctggagcgcatcaattgcnnnnnnnnnnnnnnnnnnnnnnnnnnnnnnnnnnnnnnnnnnnnnnnnnnnnnnnnnnnnnnnnnnnnnnnnnnnnnntttcagatttggaatcggcccagtttgcantgngtgcaaaccctgaccggncacactggntcngtgctttgcctccaatacgacaaccaaatcatngccagtggnagcagcgatgccaccgttcgnatttgggacgtganaaccggcganctgctgaacaccctcatncatcatnnngaagcagtnctncatttgcgcttncaggatgggatgctngtnactcgntccaaagaccgctcaatcgccgtctgggacatggtgtcaccccatgaaatcgacattcaccgggtgctggtcggccatcgggcggctgtgaatgtggtggactttgaccagcgctacattgtgtcggccagtggggaccgcacanttcagatttggaatcggcccagtttgcaatgtgtgcaaaccctgaccggncacactggttcggtgctttgcctccaatacgacaaccaaatcatcgccagtggnagcagcgatgccaccgttcggttgtgggacattgaatgcggcaactgtctgcgcgttttggagggtcacgaggagttggtccgctgcattcggttcgactcaaaacgcattgtgtccggcgcctatgaccgnaaaatcaaaatttgggacctccaagcngctttgganccnaggagcccgccgaacacactttgcttgaaaacattgtccgagcatacgggacgagtgttcagactgcagtttgatgagttccaaattgtaaggttttttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 248 - DNA, 1620 bp, Artificial Sequence
  Description of Artificial Sequence: Synthetic polynucleotide
  modified_base (138)..(138): a, c, t, g, unknown or other
  modified_base (412)..(414): a, c, t, g, unknown or other
  modified_base (726)..(726): a, c, t, g, unknown or other
  modified_base (1039)..(1041): a, c, t, g, unknown or other
  modified_base (1227)..(1227): a, c, t, g, unknown or other
  modified_base (1438)..(1443): a, c, t, g, unknown or other
  modified_base (1527)..(1527): a, c, t, g, unknown or other
  modified_base (1530)..(1530): a, c, t, g, unknown or other
  modified_base (1555)..(1555): a, c, t, g, unknown or other
  modified_base (1612)..(1620): a, c, t, g, unknown or other
atggcttcaattgcttgtcttaatcccaaagccgaacttgcccgacatgcagccgccctggagatgaacatcagcggtgccaagggtttacaggaagtgatgaagaccaacttgggaccgaaaggaacattgaaaatnctcgtttctggttcgggcgacctgaaagtgaccaaagatgggaatgtgcttctgcatgaaatgcaaatccaacacccgaccgcatcgctgattgcaaaagcctgcacggcacagaatgacgccaccggcgatggcaccacctccaccgtgctgctcattggggaactgctgaaacaggccgagacctacatcagtgatggcgttcatccccacttgatcacggaaggctttcaaaccgcctacgatgcgctcgtcaagttgctgcacgagttcnnnaagcaggcgcctattgaccgcaatttgctgattgaagtggcgcgcactgcgctccgaaccaaactggaccagaaattggccgatcacatcacggagtgcgttgtggatgcggtcctggccattcgcaaggatgagaaggagccggacttgcacatgattgagattcagcaaatggaacacgagatggagtcagacaccaagttgatccgaggccttgtgcttgaccatggcggtcgccatccggacatgccgaaaactttggagaatgtgtacattctcacgtgcaatgtttcgctggagtttgagaagacngaagtcaattccggccttttctacaaaacggctgccgagcgcgaacgcctgttgcaagccgagcgcgagtacatcaccagacgagtgcagaaaatcattgagctgaagaagcaagtctgtgacgctgcgggcgatggaaaaccccaaggctttgtggtgatcaaccaaaagggcattgacccgccctcgctcgacctgctcgcccaaaacggcattctggcactgcgccgtgccaagcgccgcaacatggaacgcctccagctggcgtgtggcggagaggcagtgaatgcggtggacgacctgacaccgaagnnnttgggttgggcgggctctgtgtacgagcatgttttgggcgaagacaagtacaccttcatcgaggactgcaagcacccaaagtcggtgaccctgctgctgaagggccccaacaagcacacaatcaaccagatcaaggacgccatctacgatggcatccgggcggtgttcaacgtgctcaaggatgtngccgtcattcctggcgctggtgcctttgaaattgccggttattgcacgttgaaaaagctggcagagagcgtgaaaggacgtgccaaactgggcgttttggcctttgccgaagccctcctgatcatccccaaaacgctggccgtcaatgcgggccacgatgcgcaggatgtgattgtgaagttggtcgaagcgtacaatgggatgggcagtnnnnnngccgttgggttggatgtggccagcggggaggcgaccattccacagggcatttgggacaatgtgcgcgtgaagcaggccagcctngcngcctgtcaaagcattgccagcaatntgttggaggtggacgaggtgatgcgggccggcatgcgcgacttgaagcagggacagnnnnnnnnn

SEQ ID NO: 249 - DNA, 1908 bp, Artificial Sequence
  Description of Artificial Sequence: Synthetic polynucleotide
  modified_base (1)..(279): a, c, t, g, unknown or other
  modified_base (339)..(339): a, c, t, g, unknown or other
  modified_base (351)..(351): a, c, t, g, unknown or other
  modified_base (360)..(360): a, c, t, g, unknown or other
  modified_base (363)..(363): a, c, t, g, unknown or other
  modified_base (368)..(368): a, c, t, g, unknown or other
  modified_base (388)..(388): a, c, t, g, unknown or other
  modified_base (390)..(390): a, c, t, g, unknown or other
  modified_base (435)..(435): a, c, t, g, unknown or other
  modified_base (462)..(462): a, c, t, g, unknown or other
  modified_base (481)..(481): a, c, t, g, unknown or other
  modified_base (525)..(525): a, c, t, g, unknown or other
  modified_base (534)..(534): a, c, t, g, unknown or other
  modified_base (537)..(537): a, c, t, g, unknown or other
  modified_base (558)..(558): a, c, t, g, unknown or other
  modified_base (570)..(570): a, c, t, g, unknown or other
  modified_base (591)..(591): a, c, t, g, unknown or other
  modified_base (594)..(1584): a, c, t, g, unknown or other
  modified_base (1776)..(1776): a, c, t, g, unknown or other
  modified_base (1834)..(1836): a, c, t, g, unknown or other
  modified_base (1873)..(1908): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccttggtgtcatccgcaaacttgactctactgaaccacgcgtgatggaattgaaagcncaaattttgtanagaatgganaanttcgnagaggccttggaattattcnanaaattgattcgcacacacagtgatgagtttgacgaccttcgacgngcaaacctgttagcgataaaggcacgncttcaagcaaaaggtgaancacaggaattggatcagatgaatgacacgttcgaattgatgtanaacaattcntgncatctcattgcgtgcgaaaantttgatgaagcnctcaaattgctcaacaaagcnctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcagccaagaagtcccgcaaagtgcgacccaaaaagaacaaaactcgtttgccagccaattatgatcctgaagttccacccgacccggaacggtggctaccgcgtcaagaacgccaggcctatcgcaagaagaaaaagttcaaagatcgggatgtgggccgaggaacccaaggagcagcagctggaccnaacaaggccaccactcctggggtggctggtccgtctcctcaagcttctccaaaaccannnactgaagggcctcgtcagcaacgcccaacgcagcagnnnnnnnnnnnnnnnnnnnnnnnnnnnnnnnnnnnn

SEQ ID NO: 250 - DNA, 1464 bp, Artificial Sequence
  Description of Artificial Sequence: Synthetic polynucleotide
  modified_base (138)..(138): a, c, t, g, unknown or other
  modified_base (843)..(843): a, c, t, g, unknown or other
  modified_base (1143)..(1143): a, c, t, g, unknown or other
  modified_base (1237)..(1239): a, c, t, g, unknown or other
  modified_base (1438)..(1464): a, c, t, g, unknown or other
atggttctggatattgacctttttcgggaagaaaagggaggcgaacctgaattaattcgagcttcacaacgtgcacgttatacagatgttggacttgttgacaaagtgattgaagcggatgtgaattggcgtaaagancgcttcaatttggatttgctgaatcggatcacaaaaatatgcagttcggcgataggagacaaaatgaagaagaaagaaccacaaggggattcggatgtattgccagcagattttgttctcaaatacgatgacatcaattcggagactttaaagcgattcacaatcaaccaaatcaaaactctgaagaagaagatggatgaagagtcgctccaaacaaaattgcgcatggaaagtttggaaaatgagaggaatgagtgtctcgtcaaaattggaaatctgctccacccgtctgtccccataagtgacaacgaagaagacaatcggatcgagaggacgttcggtgattgcaccaccaaaaagcaatattctcacgttgatttggtggtgatgtgcgacggttttgatggcgaaaggggcacaaatgtggctgggggtcgaggctattttctgaaagggccacttgtgttcctggagcaagcattgatcgggttggcattgaggatgctttccgccaaagcattcattccgctttacacgccattcttcatgcgcaaagatgtaatgcaagaagttgcgcaattgagtcaatttgacgaggaactgtacaaggtgacttccaaaggctcggaaatgagtggcgataacacagtggaagaaaagtatttgatcgccacatcggaacagccaatcgcagcattccatctngatgagtggctgaacccatcagaacttcctttgaaatacgcggggatgtcgacttgttttcgtcaagaagttggaagccatggacgcgataccagaggtattttccgggttcatcagtttgagaaagtggaacaattcgtgatttgctcgccgtttgatgaagaatcctggaaatgttttgacgaaatgattggaaacgccgaggaattctaccaagccttgaacattccataccgcgttgtgaacattgtttctggcgaactgaacaacgcagctgccaagaagtttgacttggaagtntggttcccgggcagtgctgctttccgtgaacttgtttcctgctcaaactgtaccgattaccagtcgcggcgattgcgcattcgctatgggcaannnaagaagctggatggagaggtgaattatgcgcacatgctcaatgctacaatgtgtgccacaacacgcgcaatttgcgccgtcttggaaaattaccaaaccgaagatgggattttggtgccgcccgctttaagagaattcatgcctcccaaatatgccgagcttatcccatttgtgaaaccggcaccaatcgagcaggagnnnnnnnnnnnnnnnnnnnnnnnnnnn

SEQ ID NO: 251 - DNA, 1017 bp, Artificial Sequence
  Description of Artificial Sequence: Synthetic polynucleotide
  modified_base (1)..(168): a, c, t, g, unknown or other
  modified_base (172)..(174): a, c, t, g, unknown or other
  modified_base (176)..(176): a, c, t, g, unknown or other
  modified_base (180)..(180): a, c, t, g, unknown or other
  modified_base (184)..(184): a, c, t, g, unknown or other
  modified_base (186)..(186): a, c, t, g, unknown or other
  modified_base (189)..(190): a, c, t, g, unknown or other
  modified_base (193)..(193): a, c, t, g, unknown or other
  modified_base (196)..(196): a, c, t, g, unknown or other
  modified_base (198)..(199): a, c, t, g, unknown or other
  modified_base (201)..(204): a, c, t, g, unknown or other
  modified_base (220)..(220): a, c, t, g, unknown or other
  modified_base (246)..(246): a, c, t, g, unknown or other
  modified_base (273)..(273): a, c, t, g, unknown or other
  modified_base (280)..(281): a, c, t, g, unknown or other
  modified_base (297)..(297): a, c, t, g, unknown or other
  modified_base (306)..(306): a, c, t, g, unknown or other
  modified_base (315)..(315): a, c, t, g, unknown or other
  modified_base (351)..(351): a, c, t, g, unknown or other
  modified_base (393)..(393): a, c, t, g, unknown or other
  modified_base (489)..(489): a, c, t, g, unknown or other
  modified_base (528)..(528): a, c, t, g, unknown or other
  modified_base (576)..(576): a, c, t, g, unknown or other
  modified_base (580)..(580): a, c, t, g, unknown or other
  modified_base (590)..(590): a, c, t, g, unknown or other
  modified_base (597)..(597): a, c, t, g, unknown or other
  modified_base (601)..(602): a, c, t, g, unknown or other
  modified_base (609)..(609): a, c, t, g, unknown or other
  modified_base (615)..(615): a, c, t, g, unknown or other
  modified_base (621)..(621): a, c, t, g, unknown or other
  modified_base (627)..(627): a, c, t, g, unknown or other
  modified_base (631)..(631): a, c, t, g, unknown or other
  modified_base (643)..(643): a, c, t, g, unknown or other
  modified_base (645)..(645): a, c, t, g, unknown or other
  modified_base (648)..(648): a, c, t, g, unknown or other
  modified_base (660)..(662): a, c, t, g, unknown or other
  modified_base (664)..(664): a, c, t, g, unknown or other
  modified_base (666)..(667): a, c, t, g, unknown or other
  modified_base (669)..(670): a, c, t, g, unknown or other
  modified_base (674)..(676): a, c, t, g, unknown or other
  modified_base (678)..(678): a, c, t, g, unknown or other
  modified_base (680)..(681): a, c, t, g, unknown or other
  modified_base (684)..(684): a, c, t, g, unknown or other
  modified_base (687)..(687): a, c, t, g, unknown or other
  modified_base (691)..(691): a, c, t, g, unknown or other
  modified_base (694)..(694): a, c, t, g, unknown or other
  modified_base (698)..(698): a, c, t, g, unknown or other
  modified_base (702)..(702): a, c, t, g, unknown or other
  modified_base (704)..(705): a, c, t, g, unknown or other
  modified_base (708)..(708): a, c, t, g, unknown or other
  modified_base (874)..(1017): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatnnnantgtngagngnggnnccntgnanncnnnngattatcggatttatntgaaaaatgatgatggagtgatttcnccgtggcatgacattccgtacattccngaaaacnnaatccccatcttcaanatggtcgtngaaattccncgttggagcaatgcaaaaatggaaatggccaccacngagccaatggccccaatcaagcaggacatgaagggcgagaanatgcgctacgtgaacaacattttcccatttcacggatatccctggaactatggggcattgccgcaaacttgggagaatccggaccacaaagacaantggaccaaacgggatggcgacaatgacccgattgatgtnattgagattggcaacaaggttcatccgtccggttccgttatacaagtnaaanttctcggcantttggcncttnnggacganggcganaccgantggaanctgnttgccatcgacntnaangacgagttggcnnngnanntnnacannntngnngangtngagnggnaaangccngnnctnttgacagccacctatgaatggttccgcgtctacaaaatacccaccggaaagccggccaacaaatttgcctttaacggcgagttcaaggaccgtgactttgcccatcgcatcattgaagagaccaaccagttctggaaggccctcatcgccaagcaggacccggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 252 - DNA, 774 bp, Artificial Sequence
  Description of Artificial Sequence: Synthetic polynucleotide
  modified_base (1)..(54): a, c, t, g, unknown or other
  modified_base (162)..(162): a, c, t, g, unknown or other
  modified_base (697)..(774): a, c, t, g, unknown or other
nnnnnnnnnnnnnnnnnnnnnnnnnnnnnnnnnnnnnnnnnnnnnnnnnnnnnngccgtcgatccttttactcgcaaagaatggtatgacataaaggcgccgtccatgttcaccaatcgctatgtgggcaagacactggtgaaccgaacgcagggaacagcnatttcaagcgactttctcaaaggccgagtctatgaagtctcgcttggcgacctcaacaacacggatgccgatttccgcaaattccgtctcgtctgcgaagatgtgcaagggaaggtttgcttgaccaacttccatggcatgactttcaccagggacaagctctgctcgatcgtcaagaagtggcatactctgattgaagcgaatgtctcggtgaagaccacggacggttacacgcttcgcctgttctgcattggcttcaccaagcgcaatccaaatcagctcaagaagaccagctacgcgaaaacctcgcaagtgcgtcaaattcgtgcccggatggttgagatcatgcagagagaggtccaaaacagcgacttgaagcaggttgtcaccaagctcattccggattcaatcggcaaagacattgagaagtcctgctccttctactaccctctgcaggatgtctacattcgcaaggtgaagatcctgaagaagccgaagttcgagttgggcaaactgctggacatgcatggcgagnnnnnnnnnnnnnnnnnnnnnnnnnnnnnnnnnnnnnnnnnnnnnnnnnnnnnnnnnnnnnnnnnnnnnnnnnnnnnn

SEQ ID NO: 253 - DNA, 3447 bp, Artificial Sequence
  Description of Artificial Sequence: Synthetic polynucleotide
  modified_base (1)..(564): a, c, t, g, unknown or other
  modified_base (1227)..(1227): a, c, t, g, unknown or other
  modified_base (1375)..(1632): a, c, t, g, unknown or other
  modified_base (1676)..(1676): a, c, t, g, unknown or other
  modified_base (1695)..(1695): a, c, t, g, unknown or other
  modified_base (1709)..(1709): a, c, t, g, unknown or other
  modified_base (1717)..(1717): a, c, t, g, unknown or other
  modified_base (1734)..(1734): a, c, t, g, unknown or other
  modified_base (1740)..(1740): a, c, t, g, unknown or other
  modified_base (1746)..(1746): a, c, t, g, unknown or other
  modified_base (1752)..(1752): a, c, t, g, unknown or other
  modified_base (1755)..(1755): a, c, t, g, unknown or other
  modified_base (1764)..(1764): a, c, t, g, unknown or other
  modified_base (1767)..(1767): a, c, t, g, unknown or other
  modified_base (1783)..(1783): a, c, t, g, unknown or other
  modified_base (1787)..(1787): a, c, t, g, unknown or other
  modified_base (1803)..(1803): a, c, t, g, unknown or other
  modified_base (1815)..(1815): a, c, t, g, unknown or other
  modified_base (2007)..(2007): a, c, t, g, unknown or other
  modified_base (2122)..(2124): a, c, t, g, unknown or other
  modified_base (2206)..(2208): a, c, t, g, unknown or other
  modified_base (2317)..(2319): a, c, t, g, unknown or other
  modified_base (2530)..(2730): a, c, t, g, unknown or other
  modified_base (2950)..(3447): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaagaagctataaaaactcgtgaagacaaaaagaaacttcgtcaagcggaaagaaattattacgaaattctcaccaaaatcaaaggcgacgcaaaatttgtggaaagggatgaattgattgagcaacagcgccgaaaacttccaataaacgccgaagaacagccaattattgaagcaatcaacgagaatccagttgtgatcatctgcggagaaaccgggtccgggaagactacccaagttccacaattcctttacgaagccggctatacatcaaatgggcatttgattggaatcactgaaccaaggaggattgcagcaattagcatggcaaatagggttggttatgaaatggccaaacccgaattgtcttcttatcagattcgatatgaaggcaatagaacggagcaaacaaaaatattattcatgactgatggcgttttattgaaagaactccaaacggattgcaccttatcaagttactcagtaatcatcatagatgaagcgcatgaacgatccatctacagtgatgtgctcattggcttgctctcgcgaatttgtttggctcggctgaaaaaacaatatccattgaagttggtgataatgtcagccactcttcgtctgaatgattttcttcagcaaaggtttcaatttcaatcagcncccaaagtattacaagttgattcacggcaatttccagtttctatttactttgaaaggaagacacctgagaattatatggaagccgcattcaaaaaagtttgcaaaatacatgaacaatacccatcaggaggtattcttgtcttcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatggatgacgaccaaactgacaatctctgcatcgacgattnttctcaaacaaatcaaatncctcaagaaatggntgattttntgccattgcattgtctncctctntattcnttattnccnggacatctncanaaacgtgtttttctancacnaccagagggcacaggnatttgcgtggtntcaacaaatgtggccgaaacatcgctgacaatccctaatatccgatatgtggttgacgcgggcaaggaaaagcgacgagattatgacccaattaccggagtatccagattcattgttgattggtgctctaaagcttccgcaaatcaacgttcaggacgtgctgggcgtgtccaatctggttacactttctgnctttattcgtctgcagtttatgaagatatgccaaactttaccaaccctgaaatattgaataaaccaatcgaacaacttgtgcttttcctcaagtcaatgggttttgcaaaattgnnngaatttccatttccaacaccgcccaaggctgatcaaattaaatcagcggaattgcgattacaacgactgggagcattgacannnacgccaaaaacaaaggatattcccagtcaaattacttcacttggttgcacattgtcacaaatcccattggcaccagcatttgcaaaaatacttgttctcgttccgagannnaggcttcttccctatgccgtcacattggtatcggcactttcagttcgcgaaccgctcattccgattgcggcaatcaaggccgaaactgtggagaagacaaaggagaaaatggcagaaatgctcaagcaaaggcaaatctggtgctcaatcggagaagctcgtctttttggagatctaacagttttgttgaatgttattggtgcggcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttgattgcttcccagagaaaattgcgaagaaaatcgaggaaaatgatgcaccaaaaggggcatacaagacacaactactcgaggaatatgtgtttatcgactcgagttccatgctttataaagaacagccagaatatgtgctttaccaagaaattatacaagttgctgaaaagaaagttctacaaagtgtgattgttgcagagccagaatggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 254 - DNA, 1122 bp, Artificial Sequence
  Description of Artificial Sequence: Synthetic polynucleotide
  modified_base (1)..(117): a, c, t, g, unknown or other
  modified_base (298)..(300): a, c, t, g, unknown or other
  modified_base (431)..(432): a, c, t, g, unknown or other
  modified_base (622)..(624): a, c, t, g, unknown or other
  modified_base (742)..(861): a, c, t, g, unknown or other
  modified_base (988)..(1122): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacccgaggacacggtgcaagccctgaagttcaacccgctggtgagcggagcgcccctgctggcagctggctcctgggacaacacttgccgcatctggcaggtcagcgagacgggcgccaccgagccgaaggccatgcaaaatgtgggcgcacccattctgggcgtggactggaccgagnnnagcaccaaagtgttcctggcctgtgcggacaagcaagcccgtctctgggacctgaactccaaccagcttgccgtcgttggccaacacgatgagcccattcggagttgccattggatcaccgcgccgtcctnncagtgcttgatgaccgccggctgggacaaaaccctccgtttctgggacatgcgccagctgcccacccaatcctcactggccaccatccaattgccggagcgggtgttctgcaccgacatggtctacccacttgcgtgtgtggcactcgccaatcggcacatcaagtcctacaagctcgacggacaaccgnnngaaatgcaagatgttgagtcccagctgaagcaccaaagccgatgcattgccattttcaagaacaaactcaccaaccagccaaatggctttgccctgggctccattgaaggtttggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtccaccaaacgctgtgcacggtgggcgccgacgggaagtactcctactgggacaaggatgcgcgcaccaagctgaagggctccgacccactgcccatgcccatcaccaaggcccacatccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 255 - DNA, 1260 bp, Artificial Sequence
  Description of Artificial Sequence: Synthetic polynucleotide
  modified_base (1)..(78): a, c, t, g, unknown or other
  modified_base (207)..(207): a, c, t, g, unknown or other
  modified_base (265)..(265): a, c, t, g, unknown or other
  modified_base (273)..(274): a, c, t, g, unknown or other
  modified_base (291)..(291): a, c, t, g, unknown or other
  modified_base (319)..(321): a, c, t, g, unknown or other
  modified_base (324)..(324): a, c, t, g, unknown or other
  modified_base (327)..(327): a, c, t, g, unknown or other
  modified_base (362)..(362): a, c, t, g, unknown or other
  modified_base (364)..(364): a, c, t, g, unknown or other
  modified_base (366)..(366): a, c, t, g, unknown or other
  modified_base (586)..(906): a, c, t, g, unknown or other
  modified_base (1053)..(1053): a, c, t, g, unknown or other
  modified_base (1201)..(1260): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnaggtttatcgatgaaatggccgcaaaaagtgcgggcgcaaaggccgatcggaaaccctttgattttgaggcctggtgccgggagattgaccagcatccggcattcatgaaggagttgaagaagtgcgtntttaaattttgaaaattcgaaaaatagaaaaaattctaggcactcaaatacgacgaanatgacccnnttgagtgcgcagctgcncacaaggaggagggcaatcgccactttnnnaancgncactatcgctgggccattgacgcctacacaaaagntntncgcctcgggtgtgccgactcccaactgaactctcaactttttgctaatcgggcagccgcaaaccgacggcttggaaatctgcgttctgccgtgcgagattgcatcttttcgaggcgttttcagcctgataattttaagccaattttgcgcggtgccgagtgcctgcttgagttgggccaagccggcaaatgcttggaatggattcggtccagccaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctggtctggcccctgttgctccagtacccggaatgcgcgcaaaccgattttgttgccaagtgcccggaggatgtactgcttgccgaagtgttggccgacgtttttgagcagcctgccgagtgggacgaaaagcatgaattttgngccctgtttgtgcctttgacagccagcgaagaggagggagcacatttgcgcgagatccacaatcggcacaccctcggccaagtgctggagtggcccggcgtggaagtggggcgaggccttcccgtcattcaagtctacaccagggaannnnnnnnnnnnnnnnnnnnnnnnnnnnnnnnnnnnnnnnnnnnnnnnnnnnnnnnnnnn

SEQ ID NO: 256 - DNA, 1461 bp, Artificial Sequence
  Description of Artificial Sequence: Synthetic polynucleotide
  modified_base (97)..(97): a, c, t, g, unknown or other
  modified_base (107)..(108): a, c, t, g, unknown or other
  modified_base (111)..(111): a, c, t, g, unknown or other
  modified_base (165)..(165): a, c, t, g, unknown or other
  modified_base (171)..(171): a, c, t, g, unknown or other
  modified_base (215)..(216): a, c, t, g, unknown or other
  modified_base (252)..(252): a, c, t, g, unknown or other
  modified_base (279)..(280): a, c, t, g, unknown or other
  modified_base (285)..(285): a, c, t, g, unknown or other
  modified_base (480)..(480): a, c, t, g, unknown or other
  modified_base (489)..(489): a, c, t, g, unknown or other
  modified_base (498)..(498): a, c, t, g, unknown or other
  modified_base (504)..(504): a, c, t, g, unknown or other
  modified_base (540)..(540): a, c, t, g, unknown or other
  modified_base (564)..(564): a, c, t, g, unknown or other
  modified_base (588)..(588): a, c, t, g, unknown or other
  modified_base (639)..(639): a, c, t, g, unknown or other
  modified_base (645)..(645): a, c, t, g, unknown or other
  modified_base (666)..(666): a, c, t, g, unknown or other
  modified_base (679)..(684): a, c, t, g, unknown or other
  modified_base (705)..(705): a, c, t, g, unknown or other
  modified_base (714)..(714): a, c, t, g, unknown or other
  modified_base (718)..(718): a, c, t, g, unknown or other
  modified_base (721)..(723): a, c, t, g, unknown or other
  modified_base (732)..(732): a, c, t, g, unknown or other
  modified_base (735)..(735): a, c, t, g, unknown or other
  modified_base (753)..(753): a, c, t, g, unknown or other
  modified_base (828)..(828): a, c, t, g, unknown or other
  modified_base (837)..(837): a, c, t, g, unknown or other
  modified_base (852)..(852): a, c, t, g, unknown or other
  modified_base (859)..(859): a, c, t, g, unknown or other
  modified_base (936)..(936): a, c, t, g, unknown or other
  modified_base (945)..(945): a, c, t, g, unknown or other
  modified_base (990)..(990): a, c, t, g, unknown or other
  modified_base (1002)..(1002): a, c, t, g, unknown or other
  modified_base (1047)..(1047): a, c, t, g, unknown or other
  modified_base (1324)..(1461): a, c, t, g, unknown or other
gtttcggaagcacccaattatgtgctctacgaacatgcggtcggctacacactgctgaaggtgaaggaattcgaagacattggacagattgtgcccnaggtccaacnngcnattgcgaatgcccagcgcttccaatccattgtgcaagtgcacgcctttgaaccnttcaanaacaccgaagctgcgctggaaaatgccaacagcgtttctgaagnngttgtgcatgccgatctgctgaacttcttggagtcnaatttgcccaagaagaagaagaaagtnntgctnggtgttggcgattcccgtctggccggttccatcgttgaagcgctgcccggcttacgtgtcactttcacgggagttgttcaggaagtgttgcgtgggattcgaacgcatttccatctgcttgcccgtgacttgccacatgcccagctgaacaaggcgcaactgtcgttggggcacagttattcgcgtgcaaaggtnaaattcgangttcaccgngtgganaacatggtcatccaatcgattgctttgctggaccanctggacaaggacatcaacctgttngggatgcgcatcaaggagtggtangcctaccattatccggaactcatcaagattgtgcccgatctgtacacctangtgcgntgcgcttccataatcatggancgccagaaaatgnnnnnngacgaaagcaccgaggagaanatcaaagangtgntgnnnggagatganganaaggcagccgccgtcatngaggcggcccgcacttccatgggcatggaaatttcggagttggatttgcacaacattgacttgtttgctcgtcgngtggcttcnctttccgagtatcgncaacgtntgcaccaatacatcaaggaccgcatggacagttgcgctccttccttgtctgctttgattggagagcaggtgggcgcncgtctgatntcgcatgcgggcagtctgaccaatctggccaaatatccggcatcnaccattcaaatnctgggcgcagagaaagccctcttccgagcgctcaaaacacgcganaatacgccaaagtatggactgcttttccactcttcgttcattggccgcgcagcacccaagcacaaaggcagaatcagtcgcttcttggccaacaagtgtgctatcgcatcgcggattgacagcttctcggatgttcccgtgcccacgtttggggaaatgttgcgccagcaggttgaggaacgtctgaaatactacgagaccgggacaacgcccaagaagaatttggtggtaatgcatgaggcagtggaaaaggcggttgaggagaaaataaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 257 - DNA, 4410 bp, Artificial Sequence
  Description of Artificial Sequence: Synthetic polynucleotide
  modified_base (1)..(201): a, c, t, g, unknown or other
  modified_base (715)..(4410): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagacttactgaacattgaaataccgcctatgccggaatccttatcattgaaagaaggtggagaaaggcttgtgatttcacacattgaagttgaaaacttcaaatcctattatggcaagcagatcattggcccttttcacaagtgttttacatcaattattggaccgaatggaagtggcaaaagcaatgtgattgatgctctgttgttcgtgtttggatatcgcgcatcaaaaattcgctcaaagaaagttagcgtgcttattcattcatccgctggacgcgacaatgtacaattttgtaccgtttctgttcatttttgcagaataattgaccatgaaaatggctcttatacaaaatttgccggcagcgatatcaaagtatcgagaacagcttacaaggacaactcaagcaaatatacaatgaatggaaaatcagtcaagttcaaagaaattgccgaattgctgcgctctaatggcattgatttggtacacaaccgttttctgatactccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 258 - DNA, 543 bp, Artificial Sequence
  Description of Artificial Sequence: Synthetic polynucleotide
  modified_base (1)..(51): a, c, t, g, unknown or other
  modified_base (210)..(210): a, c, t, g, unknown or other
  modified_base (366)..(366): a, c, t, g, unknown or other
  modified_base (481)..(543): a, c, t, g, unknown or other
nnnnnnnnnnnnnnnnnnnnnnnnnnnnnnnnnnnnnnnnnnnnnnnnnnntctttcagaactccatggatgttcgtgaagaaaggatcaagaggacttcgaaagatgggaccaaacacatttgagaagatcaaatggcccggccaggatcgtgaattccccgaattgtcgcccaaatttcagaaaaataatcgggaagaattgcgagtntacaccggagttgcggcaactggctttgttgatcagcaaaccaagaaattcgtacacgttcccgagatgataccggaattggtggttcccgacttgtccaactttgagctgaaaccatatgtttctttcaggaccgatgttcaaatagaagacagnttgaacgcctatgagaagaagcttgtcaaaggaggcaatgaggaaaaggcaatggaaaaatccaggcaatccgaaatatggccgccaccgaaaagtcgatccaaagctgcttttnnnnnnnnnnnnnnnnnnnnnnnnnnnnnnnnnnnnnnnnnnnnnnnnnnnnnnnnnnnnnnn

SEQ ID NO: 259 - DNA, 705 bp, Artificial Sequence
  Description of Artificial Sequence: Synthetic polynucleotide
  modified_base (1)..(90): a, c, t, g, unknown or other
  modified_base (226)..(438): a, c, t, g, unknown or other
  modified_base (540)..(540): a, c, t, g, unknown or other
  modified_base (703)..(705): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaattaaggaagagtcgagaaaattaaatcatgagcatgtggtggatgaggatcgccgatcaaagttgccgaaaaactacgagtcgaaacgtaaacggcaggaatgggaattggaagaaattgtggcaagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgaagagcaattttatccaacggccaacactttggtccagggttctcactatccaacggataaagcgctggatcgactttcggaggatgtgcacaatcanatgaagaagcgtgacgaataccatcgccgcagaatgttcgacccagatgctccaattgacttcatcaatgagcgaaacaggaaattcaatcacaaactggagcgatactatggcaagtacacagccgacatcaaagaggatttggaacgcggaactgcgatcnnn

SEQ ID NO: 260 - DNA, 543 bp, Artificial Sequence
  Description of Artificial Sequence: Synthetic polynucleotide
  modified_base (1)..(27): a, c, t, g, unknown or other
  modified_base (538)..(543): a, c, t, g, unknown or other
nnnnnnnnnnnnnnnnnnnnnnnnnnnttgaaacaatacgtcattgttggccgcaaattgcctaccgagaatgaccccaatccaaaactctacaaaatgcaaatattcgcaagcaaccatgtcgttgcaaaatcacgtttctggtacttcaccagcatgttgcgccgtgttaagaagacccatggtgaaatcgtttcatgccaagaggtttgtgaaaagaaaccaggctctgtgaagaactatggcatatggcttcgctatgattcgcgcactggacatcacaacatgtaccgtgagtaccgtgacgtcaccatggctggagctgtgactcaagcttatcgcgacatgggcgctcgtcaccgtgcaatggctgatcgtatccagatcatcaaggttcagccgatcaaagtggcggactgcaagcgtgcgggcgtgaagcaattccaagattcggccatcaagttcccattgcctcaccgcgtggccaagcgccgcaagatggctccatttaccacccaacgccccaaaacccatttcnnnnnn

SEQ ID NO: 261 - DNA, 717 bp, Artificial Sequence
  Description of Artificial Sequence: Synthetic polynucleotide
  modified_base (1)..(90): a, c, t, g, unknown or other
  modified_base (96)..(96): a, c, t, g, unknown or other
  modified_base (144)..(144): a, c, t, g, unknown or other
  modified_base (147)..(147): a, c, t, g, unknown or other
  modified_base (192)..(192): a, c, t, g, unknown or other
  modified_base (204)..(204): a, c, t, g, unknown or other
  modified_base (252)..(252): a, c, t, g, unknown or other
  modified_base (255)..(255): a, c, t, g, unknown or other
  modified_base (267)..(267): a, c, t, g, unknown or other
  modified_base (284)..(284): a, c, t, g, unknown or other
  modified_base (310)..(315): a, c, t, g, unknown or other
  modified_base (323)..(323): a, c, t, g, unknown or other
  modified_base (330)..(330): a, c, t, g, unknown or other
  modified_base (351)..(351): a, c, t, g, unknown or other
  modified_base (363)..(363): a, c, t, g, unknown or other
  modified_base (378)..(378): a, c, t, g, unknown or other
  modified_base (405)..(405): a, c, t, g, unknown or other
  modified_base (424)..(424): a, c, t, g, unknown or other
  modified_base (442)..(717): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtnaactacacggaggagcatcgccagctggcactgaaaatgatcgaggcnganatgcgcaaatttccaaagacgaaaaactacttgaagaacttcccngagcccgactangacaagttcctcacgccacgtctgattgagctgcaacaacaaatggcnaanaagcaggagatnccaaagttggactttgnccgctatgacgtgccatcgccgggcnnnnnncgagccgntaccaanaaggcgtggctggccgccatngacaattgcaangcacagcttggcaancaggcgctgcgcaaaatcaacttggancttttggatgaatacggtncaaaacttcaaattcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 262 - DNA, 597 bp, Artificial Sequence
  Description of Artificial Sequence: Synthetic polynucleotide
  modified_base (328)..(330): a, c, t, g, unknown or other
  modified_base (450)..(450): a, c, t, g, unknown or other
  modified_base (466)..(466): a, c, t, g, unknown or other
  modified_base (580)..(597): a, c, t, g, unknown or other
atgagcaatcttcgcctgcagaaacgcctggcctcggccgtgctgaagtgtggaaagggtaaaatctggctggacccgaacgaagtcaacgagatatccaacgccaactcgcgccagaacatccgtcgcctggtcaaggatgggctgatcattcgcaaaccgggcaaagtccattcgcgctatcgggctcgtgaacgtctggaggcgcgcagaaagggccgtcacatgggcttcggaaagcgtcatggtactcgcaatgcgcgtatgccggaaaaggtgctttggatgcgtcgcatgcgtgtgcttcgccatctgctcaagcgctacnnngacgccaagaagatcgacaagcatctgtaccacgagctgtacctgaaggccaagggcaatgcgttcaagaacaagcgcaacttgatggagtacatcttcaagaagaagaccgagaaccancgctccaaacagcttncggaacaatccgaagcccgtcgcaacaagaacaaggagacccgcaagcgtcgtgaggagcgcctggtgatgaagcgcaaggagttgctgcacaagatttccgagagcgaaaagnnnnnnnnnnnnnnnnnn

SEQ ID NO: 263 - DNA, 1950 bp, Artificial Sequence
  Description of Artificial Sequence: Synthetic polynucleotide
  modified_base (1)..(15): a, c, t, g, unknown or other
  modified_base (214)..(216): a, c, t, g, unknown or other
  modified_base (931)..(1107): a, c, t, g, unknown or other
  modified_base (1198)..(1203): a, c, t, g, unknown or other
  modified_base (1356)..(1356): a, c, t, g, unknown or other
  modified_base (1402)..(1407): a, c, t, g, unknown or other
  modified_base (1786)..(1950): a, c, t, g, unknown or other
nnnnnnnnnnnnnnnaattttgttcaagaaatgatgacaactcaaaagaaatcaaagccaactttgaaagaagtgcccgatgttgtctacgacgcaagcacaaaaaagtcatacaacaaaggaaagtttctgggcaaaggcggatttgcgcgatgctacgagctcatcgagaacaagaccaacaagatcttggcgggcaaagttgtgtccaagnnnctgctcatcaagaaacaccaacgcgacaagcagatgacccaggaagtccaaatccaaaagtcgcttactcatccgaacattgtcaagatggagggcttcttcgaggacgaggacaatgtctacattctgctcgagctttgcacccgccgttccttgatggagttgcacaagcgaagaagggcggtcaccgaaccggaagctcgctatttcacaaatcagattgtcctcggctgcaaatacctgcacgacaagagaataatccatcgcgacctgaagttgggcaatcttttcctcaccgaggaaatgcaagtgaaaattggcgacttcggacttgccaccacattggaatttgacgagcgcaagaagacattgtgcggcacaccaaactacatcgcgcccgagatgctcgacaagaagggccattcctacgaggttgatgtctgggccataggttgcattctctacacgctgcttgttggcaagcctccgttcgagaccgagacgctcaaggacacctacaatcgcatcaagaacaaccagtacacaattcctccacgaattggcaaggatgcggccgcgttgatcagccgactgctcgcagcagagccagcgcgtcgtccaaaggtgcaagacgtcctctcattcccattcttcaccgatgggttcttgccgaaagttctgcccatctcgagtctcacaatggcgcccaagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatggacttctatctgtcggagctgtacgcgcagttgtgctcactgatcaactcgaatcccgaccgtttcaacgatgcggagcgtggcnnnnnngaaatcgaacatccggcttccagcccgatctattgggtggcccgttgggtagactactcggacaagtacggcctcggctaccagctctccgacaacagcgttggcgtcctcttcaacgacaacaccaaggtcatcctcgacgcgcccggactncaactccaatacactgagcgcaacaacatggagcattactacgctnnnnnngctgacaaatatcctccggctctggagaagaagataacgctgctcaaatacttccgaacctacatgaatgagcatctgatcaagacgggcgccaacattccaattcgcgagggtgacgagattgcgcggctgccctgcctgaacacctggttccgcaccaagtccgccattgtgctgcacttgagcaacgggacattgcaaatcaacttcttctatgaccactcgaaactgattctctgcccactgatgggcgcggccacctacattgatcagcacaaaaatgtgttcacatgcaaattctccctggtcgagaagtttggctgtcccaaggatttgttgcagaggctgaagtacaccaaagtaaggacaaaggaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 264 - DNA, 1842 bp, Artificial Sequence
  Description of Artificial Sequence: Synthetic polynucleotide
  modified_base (1)..(753): a, c, t, g, unknown or other
  modified_base (895)..(897): a, c, t, g, unknown or other
  modified_base (1086)..(1086): a, c, t, g, unknown or other
  modified_base (1258)..(1842): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccaatcgatggcggacctcgccaaatgccaggtgattcggcgtcgactggcacgcattgtgcacgccccgttctttgccaaaaccgtcatcggctgctttgtgcgcgtccagattggggcccacgatgggaaggcgactnnntatcggattgcccaaatcacggacgttgtggaaaccgccaaaatctacgaggtcgagccgggcacggaaattcggacgaacaagatttgcaacagtgacacccaaaaagtgatccgcctggagttcgtctccaacggggacttcaccgagacggaatacgccttctggctgagcgcatgcaggaaaggncaaccccctgcccaccgtggactttgtggaacgcaacagaaggaatttgtggccgccctgaactacaactacaccgatgccgagatcaaccagatggtcaaggagaagcaacggttcaagcggaatcccaccaactttgctttccaaaaagcggagctgctcaaacagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 265 - DNA, 1428 bp, Artificial Sequence
  Description of Artificial Sequence: Synthetic polynucleotide
  modified_base (1)..(180): a, c, t, g, unknown or other
  modified_base (231)..(231): a, c, t, g, unknown or other
  modified_base (387)..(387): a, c, t, g, unknown or other
  modified_base (532)..(1428): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcccgactttggcgacaaatttgttgtggacattggtgcgggcattggncgcttcacgactgaattcgcaaaaacgagcaggaaagtggtgtcaacagactttgtggacacattcattgccaagaatcgcgaatggaatggccatttccaaaacatcgagtggcgtgtcggcgatgcccttggcttggaattcgagaatgcaagngtggactttgtgttcaccaattggctgctgatgtacctctcggatgaagaggcaattcgctttctggcaaattgcttccgctggcttcggcccggaggccatcttcatttgcgcgaatcatgctccgagccgagcacaggtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 266 - DNA, 888 bp, Artificial Sequence
  Description of Artificial Sequence: Synthetic polynucleotide
  modified_base (1)..(150): a, c, t, g, unknown or other
  modified_base (685)..(693): a, c, t, g, unknown or other
  modified_base (871)..(888): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggccgcccgaaactggtcttccgccggcgacacattcctgcgagttgccaaactgcacgaggaccagggcgactccaagtttgatgcggcccagaattacagcgaggcgggcatatgctatcgaaaggtggatctccaaaaagcggtcgactgctaccgcaagagcgccgacatctacgtcgacatgggccgcttcaacatggccgccaaagcgcacatgaccatggcggagctgtacgagtcggcgctgggctgcaaagagaagtgcatggtggagtaccagaaggcggcggactactacaagggcgaggagcagcgcagttctgccggcaaatgcctcctcaaggtggccgcattggccgccgagttggagcagtaccagcgcgcaatgcacaccttcgaggaggtggccatctacgagtcggagaacaacatgctgaagtattcggcgaaaacacatttcttccaggcacttctctgctcactttgctttgacctgttggactcacaaaaggcgttgaaacgctatgaannnnnnnnnccccaattttcggagtcccgcgagtgcaagctggtcaaggagttgatgcatgccatggaggttggcgacccggacggtttcacgggcgccgtccaagactacgacaaaatcagccgtctcgacaattggcatgtccaaatgctggtcaaggttttcagcaaatttaagggagaaaatnnnnnnnnnnnnnnnnnn

SEQ ID NO: 267 - DNA, 2079 bp, Artificial Sequence
  Description of Artificial Sequence: Synthetic polynucleotide
  modified_base (1)..(69): a, c, t, g, unknown or other
  modified_base (292)..(294): a, c, t, g, unknown or other
  modified_base (424)..(636): a, c, t, g, unknown or other
  modified_base (816)..(816): a, c, t, g, unknown or other
  modified_base (855)..(855): a, c, t, g, unknown or other
  modified_base (864)..(864): a, c, t, g, unknown or other
  modified_base (903)..(903): a, c, t, g, unknown or other
  modified_base (933)..(933): a, c, t, g, unknown or other
  modified_base (980)..(981): a, c, t, g, unknown or other
  modified_base (984)..(987): a, c, t, g, unknown or other
  modified_base (989)..(990): a, c, t, g, unknown or other
  modified_base (1108)..(1119): a, c, t, g, unknown or other
  modified_base (1198)..(1203): a, c, t, g, unknown or other
  modified_base (1509)..(1509): a, c, t, g, unknown or other
  modified_base (1727)..(1727): a, c, t, g, unknown or other
  modified_base (1761)..(1761): a, c, t, g, unknown or other
  modified_base (1788)..(1788): a, c, t, g, unknown or other
  modified_base (1841)..(1842): a, c, t, g, unknown or other
  modified_base (1844)..(1844): a, c, t, g, unknown or other
  modified_base (1846)..(1848): a, c, t, g, unknown or other
  modified_base (1850)..(1851): a, c, t, g, unknown or other
  modified_base (1860)..(1860): a, c, t, g, unknown or other
  modified_base (1863)..(1863): a, c, t, g, unknown or other
  modified_base (1872)..(1872): a, c, t, g, unknown or other
  modified_base (1879)..(1879): a, c, t, g, unknown or other
  modified_base (1881)..(1881): a, c, t, g, unknown or other
  modified_base (1884)..(1884): a, c, t, g, unknown or other
  modified_base (2053)..(2079): a, c, t, g, unknown or other
nnnnnnnnnnnnnnnnnnnnnnnnnnnnnnnnnnnnnnnnnnnnnnnnnnnnnnnnnnnnnnnnnnnnnattgaacgcatactggcggatatggaaaatggcgtttacccaaaagaattgttggatgatagtccggagttgagtgcaaaaattcaagagaatgagaagctgaagtatcggttgaacatcttgaaaagggtaatttttgaataatttacattttattacacgataatcattcatattcaggcagcttccgattctgacccaaattcatcaagcaaaggcgagnnngtggcgaacaaaagtgccaaatgtgtccctcctcctcctgccgaagcaaaagcaatcaagtattttgacgttgaggactatggcgattccataattgaaaagttgaatgacctctttgcaaaggcagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtttataaatgtcttcttgaacaaggaatatttggggaaggaaattctgatgaattgcataaagggtatatcaacacccaaaattgggaagaagcacgtcatcgttgactattcatctccaaacattgccaaacaaatgcatgttggccatctgcgctcgaccataattggcgactcnattgcaagactgctcgagttggtcggcttttccgttctncgcttaaancatgtcggcgattggggcacccaatttggaatgctgatngcctatttgcgtgagcgttacccgaactanttgaaagaaccgccgcaaattgaagatttacagactttttacaaggnntcnnnnannaaatttgatgaggacgccgatttcaaggctcatgcttaccagtgtgtggtcaaattgcaaaactttgagccggacattgtgaatgcatggaaaatgatttgtgacgttagccggaaannnnnnnnnnnnatttacaaccgtttggatgttgagttacaggagcgtggcgaatctttctaccaatcccgaatgcaatcaactgtgcaannnnnngaattggagcaagccgagttgttgattgaagatgggggacggaaattgtttttcccagaggaatgccacattccattgactttggtgaaaagtgatggcggctacacgtatgacaccagcgacttgactgcaataaagcagcgcatctttgaggagaaggccgattgggtagcaataatggtgattaaaaaataattgaaaaaactgcagacagtttttgcagccgcaagacagctgggatggtacagtccaaaggaaaagcgcatagagcacgtgcaatttggtcttgtcctcggggaagacaanaagaaatttaaaacacgctcgggtgacactgtcaaactgcaagatctgctggatgagggtgtccgtagatccagagagaaacttttgaccaaggacaatgtaaagggcttctcggagcaggaattgaacaatgcggccgaatcgcttgcgtatggctgcatcaaatatgcggacttgtcgcaatcgcgcatttgcgactatgttttttcctttgaccngatgttggacgatcgtgggaatacggcagtttanttgctttatgcttacaccagaataagntcgatcgcacggaatgcacagatcagcagggaggagatcaacaaatatttgcnngnannngnngttctcccnctngaacatccnagggaantncgnctggccaagcagatactcaaattctccgattgtcttctcacggtgctggaaaaccttcagctgaacaagatctgtgactacatttacgaattggccacccttttccatgacttctacaaggattgttatgtcgtcagcaaagttcaagaaggttggctttggctttgcnnnnnnnnnnnnnnnnnnnnnnnnnnn

SEQ ID NO: 268 - DNA, 753 bp, Artificial Sequence
  Description of Artificial Sequence: Synthetic polynucleotide
  modified_base (1)..(186): a, c, t, g, unknown or other
  modified_base (477)..(477): a, c, t, g, unknown or other
  modified_base (564)..(564): a, c, t, g, unknown or other
  modified_base (751)..(753): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcagtcgccgctattgcagacggcattggccgtagtaacattttggatgcaaaggaaaaatggaccgactacagctatgaccagctgcttgacatggtttttggcatcatgcgtgagaagaacccggaattggctggcaaaaagaagacatttgtgatgaagccgccacaagttcaacgggccggtagcaaaaagacggcattcacgaatttcgccgaaatttgccgattgctgaagcgcgaacccaagcatgtcctccaatttctgatggccgaactgggcacatcnggctcgattgacggcaaccagtgcctgattgtgaagggccgtttccagcaaaaacactttgaaaatgtgcttcgcggctatatcagngagtatgtgacttgccacacgtgccgttcctcggacacggagctgaccaaggactcccgtctcttcttcatccaatgcaaggcctgtggcagccgatgctctgtctcttccatcaagtccggattcacggccatggttggcaaacgcgcagcagcaagacgggcagccgaggccactgccggaaagnnn

SEQ ID NO: 269 - DNA, 1056 bp, Artificial Sequence
  Description of Artificial Sequence: Synthetic polynucleotide
  modified_base (1)..(81): a, c, t, g, unknown or other
  modified_base (186)..(186): a, c, t, g, unknown or other
  modified_base (310)..(414): a, c, t, g, unknown or other
  modified_base (558)..(558): a, c, t, g, unknown or other
  modified_base (649)..(651): a, c, t, g, unknown or other
  modified_base (813)..(813): a, c, t, g, unknown or other
  modified_base (1042)..(1056): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnncaagtggacgcaggacgcattattcatcttgaaaagcgccgtgagcgtgccaaagaagacattgaaaagcaacgtcagaggctggaagacgaaaagaataatctngctgctggcatttccaataaattcaccacaaacattgaccaaactgaagagaaatttaaagccagcacagttggattggtcacattggaagaagtcaaagaaagcagaatgacatctacttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagagttttgtccttcaaagattttgacgatgaagacgaagatgaacccccagttccaattgtgaagaagcgtcttggcatggatcctaccgtggacacttccttcctgcctgatcgagagcgagacgagcaaatccagcgngagcgcgagagaatcgccaaggaatggcaagaaatgcaggagaaggagaaaaacgaggagatcaccgtggccttctgctattgggacggtnnnagccacaggaaggacatcaaaacgaagaaaggcgccaccatttcccagtttctgcaaaaagcactcgaaattttccgaaaggaattcttggaattgaagttggcaacctctgaaagtttgatgttcataaaggaggatctcatcattccgcacttttacacnttccaagacttcatcaaaacacgtcagatgggaaagacaggcccactgtggcaatttgaatcagtgggtgagatacgcgtacgtcaggatgccgctttggacattggcgagagccatccagtcaaggtggttttgcgcagttggtatgaaaagaacaagcacatttacccggcatccagatgggagccttttgtgccaggaaaaacctacaaacggcaaattgacgatnnnnnnnnnnnnnnn

SEQ ID NO: 270 - DNA, 975 bp, Artificial Sequence
  Description of Artificial Sequence: Synthetic polynucleotide
  modified_base (1)..(819): a, c, t, g, unknown or other
  modified_base (973)..(975): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgccgaatacccagcgatttttggcataatcgccggcatctcgattgtcctcattgtggccgtgacattcattgtggttggcctgttgagcatggaacccgccaaagactcgatcatttaccggatgacgaacacccgtatgaagaaagatnnn

SEQ ID NO: 271 - DNA, 3003 bp, Artificial Sequence
  Description of Artificial Sequence: Synthetic polynucleotide
  modified_base (606)..(606): a, c, t, g, unknown or other
  modified_base (615)..(615): a, c, t, g, unknown or other
  modified_base (618)..(618): a, c, t, g, unknown or other
  modified_base (645)..(645): a, c, t, g, unknown or other
  modified_base (654)..(654): a, c, t, g, unknown or other
  modified_base (786)..(786): a, c, t, g, unknown or other
  modified_base (1551)..(1551): a, c, t, g, unknown or other
  modified_base (2010)..(2010): a, c, t, g, unknown or other
  modified_base (2064)..(2064): a, c, t, g, unknown or other
  modified_base (2079)..(2079): a, c, t, g, unknown or other
  modified_base (2127)..(2127): a, c, t, g, unknown or other
  modified_base (2321)..(2321): a, c, t, g, unknown or other
  modified_base (2424)..(2424): a, c, t, g, unknown or other
  modified_base (2434)..(3003): a, c, t, g, unknown or other
atgccacttcgtttggatgttaaaagaaaattattggcacggtcagaccgtgtgaaatgcgttgaccttcacccaaatgaaccatggacccttgtatcgttgtacaatggacatgtccatatttggaatcatgaaacccaacaattggttaaatcctttgaggtgtgcgaacttcccgtacgagctgcgaaattcattgtgcgcaaaaattggattgccactggttcggatgatatgcaactgcggattttcaattacaatacactggagcgtgttcatcaaatggaagcccactctgattatttgcgctcaattgctgtccatccaacgcaaccatttttgcttaccagttcggatgatatgcttatcaaactgtgggattgggaagataaatggaaactgaagcagacatttgaaggtcatacgcattatgtgatgcaattggtgatcaacccaaaagacaacaatacctttgcgaccgcatctctggacaaaacaatcaaagtttggcaattcggaagctcagtgcccaactttacactagaaggtcatgagaaaggggtgaatgcggtggattattaccatggcggtgacaagccatatctnatttcgggngcngatgatcgactcatcaaaatttgggantaccaaaanaaagcttgtgtagccactctggacggtcatgcgcataatgtgtcggctgtgtgcttccaccccgagctacccattattataactgggtcggaagattccaccgtgcgtatttggcatgccaacacaaatagnttggaaacaaccctgaattatggcctagaacgtgtctggtgcatcacagctcagaaaggctcaaatacggttgcgatcggatacgatgagggatctgtcacaatcaaaattggacgtgaagagccggctgtttccatggatgccactgggaaggtgctgtgggccaagcacactgatgtgcagcaggcaaatttgaaaacaatcgacgaacaaacacttgaatcggcacaagatggtgaacgactgactcttgcagtcaaagacatgggctccaccgaggtgtacccgcaaaaagttcaacattcgccaaatggacgctttgttgttgtgtgcggagatggcgaatacattatctacacggccactgctctccggaacaaatcttttggatccggcttggactttgcttgggcaaacgactccaacatatacgcggtgcaagagacttcacaaatgatcaaattgttcaagaacttcaaggaaattcttcaagtgcgtcccgatatcacactcgaagggcttgatgggggacatctgcttgcagcccgatccgctggctccctcattttctacgattgggaaaccggccatgtgattcgtcgaattgagattgcggcaaagcgcattttctggagcgagaacggcgacatggtggccattgcgggagaagagtcgctctatgtgctcaaatacaatgccgaagctgtggccaacgccaatgacattgggccggatggaattgaagaggcatttgaagtgattgangaattgaatgagtctgtgaaaaccggtttctggattggatattgcttcatcttcacaacaactctgaacagactcagctattatgtgggcggagaattggtcacaattgcgcacatggacaggcccctctatttgctcggctatatggccaaagaaaatcggttgttcgcttgcgacaaggatcacaacattgtttcctacaaactgcttctttccgtacttgagtaccaaacagcggtgatgcgccgtgactttgacactgccgaccgcattctgaagacgattcccgagagtcaatgcacacgggttgcgcaattcttggaaaaacaaggcttcaaaaagcaggcattggccgtaagcaaagatccacagcaccgatttgaactggcactctctctgggcgatttgcgtgccgcttatgagatggcccagcaagcggacagtgaagaaaaatggaancaattggcgcatgcagcaacaatcaaatcggagttgagattggctggcgaatgnttggccaaagccagngactttggaggccttttgttgctcgcttcttgcgctggatccagccgnttgatgtcccaactggccaacgagtcgtacagtcacggacagcataatgtttctttcctgtcaagtttcctgcttggcgacatccaaaagtgcatggacattttggtggagaatgggcgaatcccggaagccaccttctttgcgcacacctacgcgcccagtcaagtgccacggcttgtctccctgtggcgggnagcggccagccaatcgttgagtgggattagcaaacgggtcggcgagagtttggcagatccagtcaagtatgagaaccttttcccgggctttgctgaagcactnaaaatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 272 - DNA, 1338 bp, Artificial Sequence
  Description of Artificial Sequence: Synthetic polynucleotide
  modified_base (1)..(426): a, c, t, g, unknown or other
  modified_base (562)..(783): a, c, t, g, unknown or other
  modified_base (904)..(906): a, c, t, g, unknown or other
  modified_base (939)..(939): a, c, t, g, unknown or other
  modified_base (960)..(960): a, c, t, g, unknown or other
  modified_base (972)..(972): a, c, t, g, unknown or other
  modified_base (981)..(981): a, c, t, g, unknown or other
  modified_base (986)..(987): a, c, t, g, unknown or other
  modified_base (1008)..(1008): a, c, t, g, unknown or other
  modified_base (1011)..(1011): a, c, t, g, unknown or other
  modified_base (1023)..(1023): a, c, t, g, unknown or other
  modified_base (1031)..(1031): a, c, t, g, unknown or other
  modified_base (1038)..(1038): a, c, t, g, unknown or other
  modified_base (1049)..(1049): a, c, t, g, unknown or other
  modified_base (1158)..(1158): a, c, t, g, unknown or other
  modified_base (1312)..(1338): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgatggcacgcacaccaccattgtggtcccaaacagccaactgctgaatgccccactgatcactggcgacaagaccaagctgaacccagtgcttttcagcggcattgcgctcatctccgacacgaatgtgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgccaaccaagaactggctttggccctcagcaaatgggtgttgaaggaaaccggcgttttgcgcatcaaatcggtgaaacaccacattgtggggcaaaacggaccgccggccgagnnntacacgattatggacgatgtgcactacgaaatncacatcgaagagcaacgcganggcaaatggctnccatttggnggaanngatgtacagcttgaatttgtncgnattgacccgttngtgcggancacgctncagaataaaantggcaagctttccgccaacttcaaggtgcccgatgtgtatggggtgtacaagttcctggtggattaccatcgcattggctacacccatttgtacgatgtgcagcaggtntctgttcgtccacttaagcacacccaatacgagcgcttctcacgttgtgcctacccctactacacgtccgccttctccatgatgattggggttgtcctcttctccattgttttcctctactacaaagaagcgcccgtttcttcatccgccgttnnnnnnnnnnnnnnnnnnnnnnnnnnn

SEQ ID NO: 273 - DNA, 687 bp, Artificial Sequence
  Description of Artificial Sequence: Synthetic polynucleotide
  modified_base (1)..(195): a, c, t, g, unknown or other
  modified_base (271)..(273): a, c, t, g, unknown or other
  modified_base (391)..(447): a, c, t, g, unknown or other
  modified_base (646)..(687): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagaatggacgagtttgggccgagtggacttatcgaggccgcaatttgggtgtttacgagttcagtgcggacnnnaaccggtccggatggatcctgatccacaagcatgaagagagcaaatttttgggcaacaaaaaccggatggagagcattgaaatacccaaggattttccggttcctccacttcaggttnnnnnnnnnnnnnnnnnnnnnnnnnnnnnnnnnnnnnnnnnnnnnnnnnnnnnnnnncgcgccccacttgagctccacattgatccccaatttgagcatctcctcccgttcatcaagcgcgtcgagccggaaaataaaacaaccacaatttatgatgagatcaagccaaaaacatttctggacttttacggaaacatgctgcccgtcaaggtggacgcctggtcgacggatccggccaaatatgagaatcattttnnnnnnnnnnnnnnnnnnnnnnnnnnnnnnnnnnnnnnnnnn

SEQ ID NO: 274 - DNA, 585 bp, Artificial Sequence
  Description of Artificial Sequence: Synthetic polynucleotide
  modified_base (1)..(18): a, c, t, g, unknown or other
  modified_base (535)..(585): a, c, t, g, unknown or other
nnnnnnnnnnnnnnnnnnaaattagttaaaaccgatggcaaagcgccggatgatctggagaagcaggttgccacagcaatttccgagctgcaaaacaataccgagatcaaaagccagctgagcgaactctactttgtcggagcgcagcaattcgaattcaacaacaagaagtgcattctcatctggattcctgttccacaacttcgggattaccagaaaatccatccgaaattggttcgcgaactcgaaaagaagatgagcggttgtcacatcatctttgttgccaagcgacgcattctgccaaagccacagcgtggaaagaaccgcaagccgttgggccagaagcgtcctcgctcgcgaactctgaccgccgtgcacgaggcaatccttggtgacattgtcttcccagctgaagtcactggcaagagaacccgtgtcaagctggatggcaagcaagttatcaaggttcacctcgacaaggcacaactgaccaatgttgagcacaaagtggacaccttcgcgaacttgtacaagnnnnnnnnnnnnnnnnnnnnnnnnnnnnnnnnnnnnnnnnnnnnnnnnnnn

SEQ ID NO: 275 - DNA, 2277 bp, Artificial Sequence
  Description of Artificial Sequence: Synthetic polynucleotide
  modified_base (1)..(84): a, c, t, g, unknown or other
  modified_base (235)..(411): a, c, t, g, unknown or other
  modified_base (508)..(510): a, c, t, g, unknown or other
  modified_base (1099)..(1101): a, c, t, g, unknown or other
  modified_base (1110)..(1110): a, c, t, g, unknown or other
  modified_base (1140)..(1140): a, c, t, g, unknown or other
  modified_base (1146)..(1146): a, c, t, g, unknown or other
  modified_base (1161)..(1161): a, c, t, g, unknown or other
  modified_base (1222)..(1222): a, c, t, g, unknown or other
  modified_base (1224)..(1224): a, c, t, g, unknown or other
  modified_base (1227)..(1230): a, c, t, g, unknown or other
  modified_base (1234)..(1236): a, c, t, g, unknown or other
  modified_base (1239)..(1241): a, c, t, g, unknown or other
  modified_base (1243)..(1243): a, c, t, g, unknown or other
  modified_base (1246)..(1248): a, c, t, g, unknown or other
  modified_base (1251)..(1255): a, c, t, g, unknown or other
  modified_base (1257)..(1258): a, c, t, g, unknown or other
  modified_base (1260)..(1261): a, c, t, g, unknown or other
  modified_base (1264)..(1273): a, c, t, g, unknown or other
  modified_base (1275)..(1275): a, c, t, g, unknown or other
  modified_base (1546)..(1548): a, c, t, g, unknown or other
  modified_base (1939)..(2277): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnaaatgcagttatgtccgagttgtgaccggcgttgcgcatcactaccatttttcggtggccaaccatgcaggcattaagcccggagaaatcggattttcgttgccccagcgaagatggactaacgtttctttggatcaggaagttcaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatgaccaaaagccgacgacatacacgctgaaacttgttgtgaagcggatggagggcgcaacactgaattctccgcctcaagaggtttttaacnnntaataagtaaatttaatattctttccaactctgcagaccaatcttggcccgttgagtcccaacgctgtggtcatctttgaccgatcggagaactcccaaatcaacctgattggccgcagcaagggcaagtcttcccaccgtgccctcatcaaccccgactgggacttccaacaaatgggcatcggcggactggacaaggaattctcagccatcttccgccgcgcctttgcttcccgcgtgttcccacccgaattcatcgagcagttggcaatgaaacacgtgcgtggcattcttctctacggccctccagggacgggcaaaaccctgattgcgcgtcaaattggcaaaatgttgaatgctcgagagccaaaaattgtcaatggaccagaaattttgaacaagtacgtgggcgaatcggaggccaacatgcgcaagttgttcgccgaggcggaggaagaatggcgccgctgtggatcgaattcgggcttgcacatcattatttttgatgaaatcgatgcaatctgcaagcaacgcggctcaatggccggctcatcaaccgtgcacgacaccgtggtgaaccagttgctgnnnaagctgganggtgttgagcaactgaacaacattctcgtnattggnatgaccaacagaaangatatgattgatgaggcattgctgcgacccggtcgaatggaagtccagctagagatttcantnccnnnngaannnggnnnanttnnnatnnnnnanntnnatnnnnnnnnnntnagggagtacaataaacttgacccaaacgtggacctgaaggacattgcccacagaacaaagaacttttctggtgctgaaatcgaaggacttgtccgtgcagcccaatcgtcggccatgaaccgattggtcaaacctggcggaaaagtgcaagccgatgaggatgccgttgacaagctgatgatcacacgtgacgattttgactacgcgctggcaaatgacataaaaccggcctttggacacaacgacgaggaattggaccgattccttggtnnnggccttgttcactggggccctccggttgcgcgagtgctggacgagggcgacttgttgatcaaagaaacagaggcgtctgatacgcgtggctttaatactttacatgaattaggtccaccaaacagcggaaagacgttcctggctgcgcgcattgcaaagaagtccgagttcccgttcatcaaagtttgttcacccgaggacatggtcggctacagcgaaaccgccaaatgtgcccaattgcgaaaggtgtttgatgatgcgtacaaatccccactgagctgcatcatcattgacaacattgaacgactgctcgactactcgcccattggtccgcgctactccaatcttgtgttgcaagcactgcttgtactgctcggcaaacgtccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 276 - DNA, 783 bp, Artificial Sequence
  Description of Artificial Sequence: Synthetic polynucleotide
  modified_base (1)..(102): a, c, t, g, unknown or other
  modified_base (250)..(253): a, c, t, g, unknown or other
  modified_base (255)..(257): a, c, t, g, unknown or other
  modified_base (261)..(261): a, c, t, g, unknown or other
  modified_base (264)..(264): a, c, t, g, unknown or other
  modified_base (412)..(418): a, c, t, g, unknown or other
  modified_base (420)..(422): a, c, t, g, unknown or other
  modified_base (424)..(425): a, c, t, g, unknown or other
  modified_base (429)..(430): a, c, t, g, unknown or other
  modified_base (432)..(433): a, c, t, g, unknown or other
  modified_base (436)..(440): a, c, t, g, unknown or other
  modified_base (442)..(445): a, c, t, g, unknown or other
  modified_base (447)..(447): a, c, t, g, unknown or other
  modified_base (601)..(783): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgttcgctattgggccgcccgagcgatcgatgcgcccgtcacctggttccgcgagaacattgtggacgcgctgaacgaccgcaaccggctgccctactaccatcgacggctggaccgggtgcccgagattgaccagtgcggggtgnnnnannnggtntgnattttcgaggccaacgagcagtaccggctggacaaaatggtggacgccttcatcctctggatcctgaaggaccgcctggagcgctgcttcatctactgggggcccagccatctccagtgcaccaagtacctggaggagtgggaggagnnnnnnntnnncnntttnntnnagnnnnncnnnntnggctcggacacggacgtggtggacgcgtacatgaagcagaagcaccggctcatctgggagcgccgccatcccgagatcatggccgagcgcaaacgtgccgtcgaggagcacaagcaggccatgaaggagggcaaattcgatctgcgcttctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 277 - DNA, 1488 bp, Artificial Sequence
  Description of Artificial Sequence: Synthetic polynucleotide
  modified_base (1)..(51): a, c, t, g, unknown or other
  modified_base (123)..(123): a, c, t, g, unknown or other
  modified_base (219)..(219): a, c, t, g, unknown or other
  modified_base (225)..(225): a, c, t, g, unknown or other
  modified_base (228)..(228): a, c, t, g, unknown or other
  modified_base (240)..(240): a, c, t, g, unknown or other
  modified_base (291)..(291): a, c, t, g, unknown or other
  modified_base (297)..(297): a, c, t, g, unknown or other
  modified_base (348)..(348): a, c, t, g, unknown or other
  modified_base (363)..(363): a, c, t, g, unknown or other
  modified_base (378)..(378): a, c, t, g, unknown or other
  modified_base (420)..(420): a, c, t, g, unknown or other
  modified_base (556)..(556): a, c, t, g, unknown or other
  modified_base (559)..(560): a, c, t, g, unknown or other
  modified_base (562)..(564): a, c, t, g, unknown or other
  modified_base (567)..(567): a, c, t, g, unknown or other
  modified_base (645)..(645): a, c, t, g, unknown or other
  modified_base (894)..(894): a, c, t, g, unknown or other
  modified_base (915)..(915): a, c, t, g, unknown or other
  modified_base (921)..(921): a, c, t, g, unknown or other
  modified_base (925)..(925): a, c, t, g, unknown or other
  modified_base (981)..(981): a, c, t, g, unknown or other
  modified_base (994)..(994): a, c, t, g, unknown or other
  modified_base (1023)..(1023): a, c, t, g, unknown or other
  modified_base (1029)..(1029): a, c, t, g, unknown or other
  modified_base (1041)..(1041): a, c, t, g, unknown or other
  modified_base (1132)..(1134): a, c, t, g, unknown or other
  modified_base (1486)..(1488): a, c, t, g, unknown or other
nnnnnnnnnnnnnnnnnnnnnnnnnnnnnnnnnnnnnnnnnnnnnnnnnnnaaagttcatttacaaaacaatttttcgtaatcagaagcagacttggttgttattggttcgggaccgggcggntatgttgctgccataaaggctgcccaacttggcatgcgcacatattgcattgagaagaacgacacacttgggggaacttgtctgaatgttggttgnattccntcnaaggcattgctnaacaattcgcatttctatcatatggcaaagcatgaccttaattcaagaggngttgangtgacaaccaaattaaacctcgaacaaatgatgaaggcgaaattggcatcngtgaaagccttgacnagtggaattggttcnctcttcaaagccaataaagtgacacatttgcaaggtgttggnacaatcactgggcctaatcaagtttctgtgaaaaagaatgacgggaaaacggaggttgtaaagacaaagaacattttgattgcttctggctccgaggttactccgttcccaggcatagaaattgatgaagaacagnttnntnnntcnactggagcgctggcgttaaagaaagtacccgaaaagatggtagtgattggtgccggtgttattggacttgaattgggnagtgtttggcaacgcctgggtgctgatgtgactgctgtggagtttctgggtacaatcggaggtgttggcgtagatggtgaagtggccaaacaattccaaagattcctcggcaaacaaggcttcaaatttatgttgaacaccaaagttatcagtgcgaacaagcaaggtggaaaaattcaagttcaagtggaaggcgccaaagatggcaaaaagcaaacattggattgtgatgtcctgcttgtttgtatnggtagacggccatataccacngatctnggcntggaaaatgtcagcctaaaattggatgagcgtggtcgggtgcccgtcaatgaacanttccaaaccacanttccatcaatttacgcaattggcgatgtnatccangggcccatgctngcgcacaaagccgaggatgaaggcattttggctgttgagggaatggctggtggaccagtgcatatcgactacaattgcattccatcggttnnntacacccatcctgaagtagcttgggttggaaaggcggaggaacaacttaaacaagagggtgttaactacaaggttggaaaattcccatttattgccaactctcgggcaaaaaccaacaacgatgtggaaggttttgtgaaagtaattggagagaaggacactgaccgattgcttggagtgcacatcattggcccaaatgctggcgaaatgatcgccgaagcgacattagcacttgagtatggagcttcctgtgaggacattgcgcgagtgtgccacccacatccgaccctttctgaagcattccgtgaagcgaatttggccgcctattgtggaaaggcaatcaacagtattnnn

SEQ ID NO: 278 - DNA, 3522 bp, Artificial Sequence
  Description of Artificial Sequence: Synthetic polynucleotide
  modified_base (1)..(135): a, c, t, g, unknown or other
  modified_base (582)..(582): a, c, t, g, unknown or other
  modified_base (1029)..(1029): a, c, t, g, unknown or other
  modified_base (1104)..(1104): a, c, t, g, unknown or other
  modified_base (1110)..(1111): a, c, t, g, unknown or other
  modified_base (1149)..(1149): a, c, t, g, unknown or other
  modified_base (1201)..(3522): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttaaataatcagatgaaaaactggtcaaatcacttcttgaatgtcgaatcaactgcctgaatttccacctgatcaaagtgatcggacgaggcgcttttggtgaagtccaacttgttcggaatgttcaaaacaagaaggtttacgcaatgaaattgttggacaaggagaaaatgatccgtcgctcggatgcggcatttttctgggaagagcgcgacatcatggcctattgcgactcggaatggatcgtgaaactgcattacgcgttccaggatcctcggaatctgtacatggtcatggaattcatgccgggtggcgactttgtgaacttgatgtccaaccatgacattcccgaggattgggcccaattctacacagccgaactggtgttggcactcaatgccatccacatgatgggctacatccacagagacgtgaaacccgtnaacatgctgatcgccgcaaatggtcacatcaagctggccgattttggcacttgcgtcaaaatgaacccagacggccttgtccgctgctcaaccgccgtcggaacgcccgattacatcagcccagaagtgctgcgagtgcagggaggcgaaggcgtttacggccgagaagtggattggtgggcagtcggcgtcactttgtacgaaatgctcgttggcgagaccccattctattcggattccctggtgaccacctactcgcacatcatggacgtcaatcggagtctgaaattccccgacgatgtcaaaatctccgagcaagccaaggatttggtgcgcaaattcctttccgaacccaatgtacggcttggacggaatggggtggccgccatcaaagcgcatcccttctttgccaatccaagatggacttttgacacaattaagaatganactccgccttatgtgccccagctgaccagcgatgaggacacctcacactttgaagatgttgagccggcagatccnaagaanntggaaacattccaagtcccgaaggctttctccggcaangaactgcctttcatcggcttcacctactccaacgagttcggcccactggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 279 - DNA, 837 bp, Artificial Sequence
  Description of Artificial Sequence: Synthetic polynucleotide
  modified_base (1)..(192): a, c, t, g, unknown or other
  modified_base (558)..(558): a, c, t, g, unknown or other
  modified_base (699)..(699): a, c, t, g, unknown or other
  modified_base (835)..(837): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccatgggaaaaggatgccgtcgagcagacaattgagcgcatgaacgagcacaattctgcccaatatcagaagaagttcttccgcaagggccacaaggacatcccgcccattccggcggcggattggacaatctttcccggggacatggtggaagtgatggtcggcaaggacaaaggcaaacagaacattgtgtcgcacatcatcagggaagagaatgccgtctttgtggagggattgcacacaaagcttgaaaaaagcgaggaagttaggcaaagacttggacgcggagaatacgacatctacacggaacagccactttttgtgcatctgggccaagtgaagctggtggattcaaatgacagngaaccttgtgaagtcaaatgggtgctgaacgactcgaaaacagagtacatacgggtgagcacaaggaccggctatgaaataccgatgccatcatcgtcacaacgcacttttgagtacacaaccccggccacctacattgangtggaaggcaaagacacaccagccgaagaagtgctcaaattgacctacaagccaaggctgtgtacctttgaacaagaaattgaggaagaaatgggcttggagaagcgctcaaacaaagaacccacatattggtatnnn

SEQ ID NO: 280 - DNA, 480 bp, Artificial Sequence
  Description of Artificial Sequence: Synthetic polynucleotide
  modified_base (52)..(54): a, c, t, g, unknown or other
  modified_base (57)..(70): a, c, t, g, unknown or other
  modified_base (72)..(74): a, c, t, g, unknown or other
  modified_base (76)..(78): a, c, t, g, unknown or other
  modified_base (82)..(82): a, c, t, g, unknown or other
  modified_base (124)..(124): a, c, t, g, unknown or other
  modified_base (181)..(181): a, c, t, g, unknown or other
  modified_base (187)..(187): a, c, t, g, unknown or other
  modified_base (364)..(480): a, c, t, g, unknown or other
atgaaattggagacttgcgtcttttctggctacaaaatccatccgggccatnnnaannnnnnnnnnnnnncnnncnnnaagnttcaaatcttcctgagcgccaaatgccagcgcggctctgccntgaagcgcaatcctcgtgacgtcccatggaccgtgctgtaccgtcgcaagcacaagnagggantgcacgccgaggaaggccagcaaaagaagcgtgtcaagcgcactgtccaggtcgcctctcgaccaatcgccgacctgactgtggaggctctgttggcgcaacgcaaccaaaagcccgaattccgaaagcagcagcgtgacgcggccatcaaggcggccaaggaggcggtgcgggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 281 - DNA, 627 bp, Artificial Sequence
  Description of Artificial Sequence: Synthetic polynucleotide
  modified_base (1)..(12): a, c, t, g, unknown or other
  modified_base (21)..(21): a, c, t, g, unknown or other
  modified_base (39)..(39): a, c, t, g, unknown or other
  modified_base (360)..(360): a, c, t, g, unknown or other
  modified_base (385)..(385): a, c, t, g, unknown or other
  modified_base (529)..(627): a, c, t, g, unknown or other
nnnnnnnnnnnncgctctggnacagcggtgccgccggtnccgacaaaaacatgccaattcaagttggtgttgctcggcgaatcggccgttggcaaatcctcgcttgtcttgcgcttcgttaaaggccaattccatgaataccaagagtcgaccattggagccgcatttctcactcagacaatttgcctggacgacgccacagtgaagttcgagatttgggacaccgccggccaggagcgataccactctttggccccaatgtactatcgcggtgctcaggctgccattgttgtctacgacatcacaaaccaggagtcttttgccaaagccaaaaactgggtgcgtgagttgcagcggcangcctcgccaaacattgtgatcgcantgtccggaaacaaagcagacctggcagccaaacgggtggtggaatacgaagaggcacaagcctacgccgaggacaatggccttctcttcatggaaacttcggccaagtcctcgatgaacgtcaacgacatcttcctcgcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 282 - DNA, 7662 bp, Artificial Sequence
  Description of Artificial Sequence: Synthetic polynucleotide
  modified_base (93)..(93): a, c, t, g, unknown or other
  modified_base (105)..(105): a, c, t, g, unknown or other
  modified_base (135)..(135): a, c, t, g, unknown or other
  modified_base (448)..(567): a, c, t, g, unknown or other
  modified_base (679)..(679): a, c, t, g, unknown or other
  modified_base (681)..(681): a, c, t, g, unknown or other
  modified_base (684)..(686): a, c, t, g, unknown or other
  modified_base (688)..(688): a, c, t, g, unknown or other
  modified_base (690)..(690): a, c, t, g, unknown or other
  modified_base (693)..(696): a, c, t, g, unknown or other
  modified_base (699)..(704): a, c, t, g, unknown or other
  modified_base (708)..(708): a, c, t, g, unknown or other
  modified_base (712)..(713): a, c, t, g, unknown or other
  modified_base (718)..(718): a, c, t, g, unknown or other
  modified_base (721)..(721): a, c, t, g, unknown or other
  modified_base (723)..(724): a, c, t, g, unknown or other
  modified_base (732)..(735): a, c, t, g, unknown or other
  modified_base (737)..(737): a, c, t, g, unknown or other
  modified_base (741)..(741): a, c, t, g, unknown or other
  modified_base (743)..(743): a, c, t, g, unknown or other
  modified_base (747)..(749): a, c, t, g, unknown or other
  modified_base (759)..(759): a, c, t, g, unknown or other
  modified_base (762)..(762): a, c, t, g, unknown or other
  modified_base (771)..(771): a, c, t, g, unknown or other
  modified_base (774)..(778): a, c, t, g, unknown or other
  modified_base (780)..(780): a, c, t, g, unknown or other
  modified_base (783)..(783): a, c, t, g, unknown or other
  modified_base (786)..(786): a, c, t, g, unknown or other
  modified_base (789)..(789): a, c, t, g, unknown or other
  modified_base (798)..(798): a, c, t, g, unknown or other
  modified_base (801)..(801): a, c, t, g, unknown or other
  modified_base (804)..(805): a, c, t, g, unknown or other
  modified_base (807)..(807): a, c, t, g, unknown or other
  modified_base (815)..(817): a, c, t, g, unknown or other
  modified_base (820)..(820): a, c, t, g, unknown or other
  modified_base (824)..(824): a, c, t, g, unknown or other
  modified_base (828)..(828): a, c, t, g, unknown or other
  modified_base (831)..(831): a, c, t, g, unknown or other
  modified_base (833)..(833): a, c, t, g, unknown or other
  modified_base (835)..(837): a, c, t, g, unknown or other
  modified_base (842)..(844): a, c, t, g, unknown or other
  modified_base (847)..(848): a, c, t, g, unknown or other
  modified_base (850)..(850): a, c, t, g, unknown or other
  modified_base (852)..(854): a, c, t, g, unknown or other
  modified_base (856)..(859): a, c, t, g, unknown or other
  modified_base (861)..(864): a, c, t, g, unknown or other
  modified_base (867)..(868): a, c, t, g, unknown or other
  modified_base (870)..(870): a, c, t, g, unknown or other
  modified_base (874)..(874): a, c, t, g, unknown or other
  modified_base (876)..(876): a, c, t, g, unknown or other
  modified_base (885)..(885): a, c, t, g, unknown or other
  modified_base (893)..(895): a, c, t, g, unknown or other
  modified_base (897)..(897): a, c, t, g, unknown or other
  modified_base (900)..(901): a, c, t, g, unknown or other
  modified_base (903)..(903): a, c, t, g, unknown or other
  modified_base (907)..(909): a, c, t, g, unknown or other
  modified_base (918)..(918): a, c, t, g, unknown or other
  modified_base (921)..(923): a, c, t, g, unknown or other
  modified_base (925)..(925): a, c, t, g, unknown or other
  modified_base (929)..(936): a, c, t, g, unknown or other
  modified_base (1128)..(1128): a, c, t, g, unknown or other
  modified_base (1167)..(1167): a, c, t, g, unknown or other
  modified_base (1170)..(1170): a, c, t, g, unknown or other
  modified_base (1230)..(1232): a, c, t, g, unknown or other
  modified_base (1423)..(1425): a, c, t, g, unknown or other
  modified_base (1440)..(1440): a, c, t, g, unknown or other
  modified_base (1475)..(1475): a, c, t, g, unknown or other
  modified_base (1477)..(1477): a, c, t, g, unknown or other
  modified_base (1481)..(1484): a, c, t, g, unknown or other
  modified_base (1509)..(1509): a, c, t, g, unknown or other
  modified_base (1653)..(1653): a, c, t, g, unknown or other
  modified_base (1668)..(1668): a, c, t, g, unknown or other
  modified_base (1681)..(1686): a, c, t, g, unknown or other
  modified_base (1689)..(1689): a, c, t, g, unknown or other
  modified_base (1711)..(1719): a, c, t, g, unknown or other
  modified_base (1728)..(1728): a, c, t, g, unknown or other
  modified_base (1770)..(1770): a, c, t, g, unknown or other
  modified_base (1777)..(1777): a, c, t, g, unknown or other
  modified_base (2151)..(2151): a, c, t, g, unknown or other
  modified_base (2368)..(3534): a, c, t, g, unknown or other
  modified_base (3564)..(3564): a, c, t, g, unknown or other
  modified_base (3570)..(3570): a, c, t, g, unknown or other
  modified_base (3591)..(3591): a, c, t, g, unknown or other
  modified_base (3603)..(3603): a, c, t, g, unknown or other
  modified_base (3605)..(3605): a, c, t, g, unknown or other
  modified_base (3621)..(3621): a, c, t, g, unknown or other
  modified_base (3624)..(3624): a, c, t, g, unknown or other
  modified_base (3714)..(3714): a, c, t, g, unknown or other
  modified_base (3718)..(4518): a, c, t, g, unknown or other
  modified_base (4536)..(4536): a, c, t, g, unknown or other
  modified_base (4557)..(4557): a, c, t, g, unknown or other
  modified_base (4563)..(4563): a, c, t, g, unknown or other
  modified_base (4602)..(4602): a, c, t, g, unknown or other
  modified_base (4882)..(5199): a, c, t, g, unknown or other
  modified_base (5557)..(5676): a, c, t, g, unknown or other
  modified_base (6012)..(6012): a, c, t, g, unknown or other
  modified_base (6066)..(6066): a, c, t, g, unknown or other
  modified_base (6343)..(6648): a, c, t, g, unknown or other
  modified_base (6808)..(6810): a, c, t, g, unknown or other
  modified_base (7048)..(7215): a, c, t, g, unknown or other
  modified_base (7527)..(7527): a, c, t, g, unknown or other
  modified_base (7645)..(7662): a, c, t, g, unknown or other
atgggcgtccttacgcttaacattgaatgccgtgagcgtggtgtcaagaagacaatgcagtttgagcctagaacacttgtccatgatgtttgncggctgattcgngacaaacttggaccaatgcctggaaaccanaatgattatggcctgtaccgtgtggaagatgatccgctaaaatgtgtttggatggagaatggacgcacattggaatattatttgatccggaatggggacacacttgaatacaaaaataaaattagacctttgagggttcgaacattggatggggccgtgaaaaccgtttttgtagatgaatctcagccagtttcccagctaatggttgtcatttgctccaagatgggcattgccaatcacgaagaatattctcttgtgcgcggatcacatcctgagattgatggaactgaaaatggttatggtcatcaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcaaaattgcacactgacgaggagctgcactgggttgatcattccaaaacccttcgagaacaagacattggtgaagatgaggagttgacgctgaggaggaaatactttntntcnnncncnaannnngannnnnncganccannccaantgnanntgctttannnncnatgncncgannnagtgctgcgnggnttgcatccngtnnnnngnganacngcnatcaaattngcngcnntncaatgctnnntcnagtntggnccntntnnnatggnnngtnntnannngnnnntnnnngcnnanaacntnttgcccaangaatatgnnnangcnnangaannngagaagaanatnnncnaggnnnnnnnngaactcatgtacgaggactcggccgcgcccaagaagaaatattgcgaactgtgtcaatcactaccaacctatggagtcacctttttccttgtcaaagagaagcttccaggcaaaaatcggctgattccacggcttcttggcgttaacaaagactcagtgatgcgcgtggatgaacggactaaatcagtattnaaggagtggccacttgaacaagttcgccgctgggctgcntcntacaaaacattcactcttgactttggagattacaaagatggctactattccgtgcagacnnnggaaggcgagcgaattggccaactgattggcggctacattgacatcatcctgaagaagaaacgcattgttgaccacaccggcattgagggcgacgaaggtgccaccatggtggaggatattgtggccccggccaaagcaaccctgatggcccaaagtgaattgaatccgattgttgcccaagagcatggcnnnacaccactccatggngttcttcgttcagcgactggcacacccacaagagntntttnnnntcctcaatatggaggtgtgagtggnatgattctggcccaggaaatgccacgtggtgagcgtgtacgctacatggatgcgcgtgaaaggagtcaaagggcgctcatcggcacaattgaagcaaccatcagagctgttgaagaagcagaagaagaaattgcaaaaccgccncaaattgatttgccncgttttggtgaannnnnnacncagcgccattggcgtgtcgagnnnnnnnnngtggaaaangaggcggttggagaccgtttggcagcaatgggtgcagcaacngcagaantaaccgcaatcccggaagaatccgctgttgacacccgtgttggcaatgcaattgcaaccattggctcaaatttgccggaaatgggccgaggcgtgcgcgaattggccgctctcatgccggatgaacaccgtggcgatcttattgatgcggcaagaaaactttgtggcgcattcggcgatttcctggagaaagtccatcctgaacatcaagagaagcgagcaaacattctgtcggctgcaagtcgtgttggcgaactttcacacgatgtgatcagcacaatgcaagagcgtacagaagaggagcgctccttccatgacgaattaaaccgtaaagccagagccgttgcaactagcactgcccaactcgttcttaangcaaagacggtatcagccgactgtgaagaaccagcattgaaggatcaagtcattcacagtgcaatgaagacggcatttgccacttcagaattggttgcctgcactcgtgttgtgggccccacaatagaacatcaaccatgcaaagaacatttgacagaggcagcacatggcgttgcccgggctgtccaagacttgctagaagatgccagcaaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattatttctagtctaatacttaatgcncgtacngttatacatgattccggccgngtttttgatcgnanacgggaacgaagttcntcncctttgttggaagaggccgccagaactgtgactgaatcactcaggaaaacattggcctctttgcctgacaatatgtacatcgatcaagcngtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaggacacaaccaanatagctacccacgcatccacnattgcnaacatttgtcgtgatgcttcagaaaaggcggcaaatgtnagtgttcggacacaatttgtgaacattgctcgcgagataacttcaattacggccgcattgattacagctgtcaagcaatttgatcaaaccggaaatgaagttaatgaatgcacagaacatgcgaggaaattgcgctccgctattagcaacttgcagaaatttctggacaatcctgattttggtgcaattcctgcaaaaatttcagtggccggtcgccaagcacaacaaccattgattcaatcggcgcggcaaatgcttgacgccagttcggaaatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaataagtcatgcggaagcaattggtcgaaatgttcgtcaacaattagcttcggtccaaacacttacccaagcatgtgtacaggcagcttcacttacctatgactcaagaacgcaaactaatctgtttgaacaatgcaaaactgttttggaagcaagcatacaacttatgtttgcaataaaagatgctggaggaaaccccaaggccgtagaactgcacacaattgttgaggaaagtgccgagcaacagagattggcactgatagaacttttacgacaagtgcaattgcttgattccgagtcgggtgtcttgaatggaatcatagacaacatttcgcgatcaattgctgtagctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaggacaactttctttgcgtttggctgaaagtttccgttcacttgcggaagacacccaaattgcacaaaatttgatgaattcaccagaattgggtcaacgcttaaaagcgggtgtacaaaggtataatagttggataataattataacaaggcaatactttttaaagttgggtacagtttcgattgaattggtttatcaacagctctcacagcattccattatggtgcaagaacgagtgcgagaagttttggctgttctctcagaaggttcccgcggcacccaagcatgcataaacgcagcacaaactgtttctgggattattggggacttaatnacaacaattatgttcgccacttctggctcattaaatccccctcaacaaaaaaantttggcgaccatcgtgatgtgatcataaaaacagcaaaagcacttgttgaagatacaaaggctttggtcagtggcgccgcttccaatcaagaacaattggcagtggccgcgcaaaatgcggttcgaacaattttgcaattgacagaagcagtcaaaaatggtgcctcaaaactttcgccagattccattgaatcacaagtcatggttattcatgctgtgcgcgatgttgctgccgcattgtccaatttaatccaagcaacaaccatgcttcagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcttgaagctgcaaatatggcacgccaatcagtcagtgagctgctaactattgtgcgtggagcatcacagagtgccgataatgcggaactgaaatatcgtatggttaattccggaagagaagttgcgctccaagtgaagcatttgttggcaacattannnctacagctccattcccgtcctgaccacccagcaaccaaacaagccattctgactgcatcccgagaaattgcaaagatggttggcgatttggcaaattatggtgaacaattgacctcgagtccattaggttctgaagaaaaaatggcctcagtaactgctgaaaatgaactgttaggggcagcaagctccatcgaagcaaattcacacaaattggcattgcttcgcccgcgacaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatggacagaagggttggtttcagcggcaaagcttgttgcggcagccacatcgcaactttgtgaggccgccaatggcttggtgcaaggccattccacagaagaaaagctggtagccgcagctaaacaagtggcatcctcgacagcgcatttgttggtggcatgcaaggtcaaatccgatctggacagtcgcgcaatgcaacgtcttcaaagtgccggtcatgcagtgaagacggcaaccgaacatctggtgaacgcggccaaacaggcgatcacagaagaggattgccgcggtttagtcatatcagacaanataaggggggtctaattgaaggttttgggagcccatgaagaggtgctgcgaaaagagagagaactcactgaggcaaggaatcggcttgcagccatcaacaaatcccgttatgagaagnnnnnnnnnnnnnnnnnn

SEQ ID NO: 283 - DNA, 1572 bp, Artificial Sequence
  Description of Artificial Sequence: Synthetic polynucleotide
  modified_base (1)..(237): a, c, t, g, unknown or other
  modified_base (490)..(828): a, c, t, g, unknown or other
  modified_base (958)..(958): a, c, t, g, unknown or other
  modified_base (960)..(960): a, c, t, g, unknown or other
  modified_base (962)..(962): a, c, t, g, unknown or other
  modified_base (972)..(972): a, c, t, g, unknown or other
  modified_base (1014)..(1014): a, c, t, g, unknown or other
  modified_base (1038)..(1038): a, c, t, g, unknown or other
  modified_base (1060)..(1158): a, c, t, g, unknown or other
  modified_base (1257)..(1257): a, c, t, g, unknown or other
  modified_base (1381)..(1572): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcagtaagagtgggtgcccgattgatggactactacaaaatgcaacaaattgtcaactggttgcccacaatcaaagagaagatcgactttgttaacccgtacgaacgggattgggaacaatcggagaagcgatggcacagggcttggcttcaacccctggtacgtcctcgaagagcctgggctgtgcccccattgcccgcctattttgacacattggatttctacaaacatatcacaaaatgccgactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgtcgtttgggtgaactcgccttcacaatgcgcgatcagcacattttgcaagtgcgcagcaaaaagccaatgaaaaatcttttcccaatggacactgatcggctgcacactcaacatttccccgcanantncaatgttgangaggtgatcttctcaccaaaaatgttcaatttgttcccgganggggctccactttggcaatgcccnggctatgaatatgacagcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggccgaagagaagcatgaaaccatggagcaatgtgtgcaggcaacagccattgtttccctcttcaattggctcaatgctcaggcccattgcttggtncacacccaatacacggaaatcgaagagccgctcacctcccaactggtgcttacagatgggcaacaattttggtttgctgtgggccaactgaacacaattgccatcaatgtggaggcggatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 284 - DNA, 1347 bp, Artificial Sequence
  Description of Artificial Sequence: Synthetic polynucleotide
  modified_base (93)..(93): a, c, t, g, unknown or other
  modified_base (123)..(123): a, c, t, g, unknown or other
  modified_base (165)..(165): a, c, t, g, unknown or other
  modified_base (168)..(168): a, c, t, g, unknown or other
  modified_base (171)..(171): a, c, t, g, unknown or other
  modified_base (243)..(243): a, c, t, g, unknown or other
  modified_base (303)..(303): a, c, t, g, unknown or other
  modified_base (588)..(588): a, c, t, g, unknown or other
  modified_base (747)..(747): a, c, t, g, unknown or other
  modified_base (844)..(844): a, c, t, g, unknown or other
  modified_base (847)..(850): a, c, t, g, unknown or other
  modified_base (852)..(852): a, c, t, g, unknown or other
  modified_base (855)..(856): a, c, t, g, unknown or other
  modified_base (858)..(859): a, c, t, g, unknown or other
  modified_base (862)..(862): a, c, t, g, unknown or other
  modified_base (864)..(864): a, c, t, g, unknown or other
  modified_base (867)..(867): a, c, t, g, unknown or other
  modified_base (873)..(873): a, c, t, g, unknown or other
  modified_base (876)..(876): a, c, t, g, unknown or other
  modified_base (879)..(880): a, c, t, g, unknown or other
  modified_base (882)..(882): a, c, t, g, unknown or other
  modified_base (885)..(885): a, c, t, g, unknown or other
  modified_base (888)..(888): a, c, t, g, unknown or other
  modified_base (890)..(890): a, c, t, g, unknown or other
  modified_base (900)..(900): a, c, t, g, unknown or other
  modified_base (904)..(904): a, c, t, g, unknown or other
  modified_base (916)..(916): a, c, t, g, unknown or other
  modified_base (918)..(918): a, c, t, g, unknown or other
  modified_base (924)..(925): a, c, t, g, unknown or other
  modified_base (927)..(928): a, c, t, g, unknown or other
  modified_base (930)..(934): a, c, t, g, unknown or other
  modified_base (936)..(936): a, c, t, g, unknown or other
  modified_base (945)..(946): a, c, t, g, unknown or other
  modified_base (949)..(951): a, c, t, g, unknown or other
  modified_base (954)..(954): a, c, t, g, unknown or other
  modified_base (957)..(958): a, c, t, g, unknown or other
  modified_base (960)..(960): a, c, t, g, unknown or other
  modified_base (964)..(964): a, c, t, g, unknown or other
  modified_base (966)..(966): a, c, t, g, unknown or other
  modified_base (969)..(969): a, c, t, g, unknown or other
  modified_base (976)..(976): a, c, t, g, unknown or other
  modified_base (978)..(978): a, c, t, g, unknown or other
  modified_base (981)..(984): a, c, t, g, unknown or other
  modified_base (987)..(987): a, c, t, g, unknown or other
  modified_base (990)..(990): a, c, t, g, unknown or other
  modified_base (994)..(994): a, c, t, g, unknown or other
  modified_base (997)..(1000): a, c, t, g, unknown or other
  modified_base (1003)..(1012): a, c, t, g, unknown or other
  modified_base (1015)..(1018): a, c, t, g, unknown or other
  modified_base (1020)..(1020): a, c, t, g, unknown or other
  modified_base (1026)..(1026): a, c, t, g, unknown or other
  modified_base (1029)..(1029): a, c, t, g, unknown or other
  modified_base (1031)..(1031): a, c, t, g, unknown or other
  modified_base (1035)..(1035): a, c, t, g, unknown or other
  modified_base (1039)..(1039): a, c, t, g, unknown or other
  modified_base (1048)..(1050): a, c, t, g, unknown or other
  modified_base (1053)..(1053): a, c, t, g, unknown or other
  modified_base (1057)..(1057): a, c, t, g, unknown or other
  modified_base (1059)..(1062): a, c, t, g, unknown or other
  modified_base (1067)..(1070): a, c, t, g, unknown or other
  modified_base (1075)..(1076): a, c, t, g, unknown or other
  modified_base (1078)..(1080): a, c, t, g, unknown or other
  modified_base (1083)..(1083): a, c, t, g, unknown or other
  modified_base (1099)..(1347): a, c, t, g, unknown or other
atggcagaaattggaaattttgaaattaaaaacatctcaaagattgaacgtattggcgcacattcccacattgttgggcttggtctcaaatcnaattatgaaccttttcctattgccgaaggnatggttggtcaacatgcggccaggaaagcagcaggtttgatngtnaanatgataaaggttggacaaattgctggtagagccttgttgattgttggagagccaggcactggcaaaacagcngtggccatgggtatttcaaagtcaattggtgaaggcaccccatttgtgtcaatttctgcnagtgaagtgtactcaatggacatgagcaaaaccgaggcattgacccaagcattcaggaaagcaatgggcgtgcgaattaaagaggaaaccgaggtactccgaggagaagttgtccatgttgagattgaccgcccggcaacgggaatcgggcctaaagttggaaaattgacacttaaaacaacagatatggaggccatctatgacattggaagcaaaatgacagaatctgtaatcaaagcgcgtatcacaccgggagatgtcatccaaattgataaagcaaccganaagattgaaaagatcggacgatcccaagcaaaatcaaaagactatgatgcccttggtccgcaggttaaacttgtggcttgtccttccggcgaaatccagtcaagaatggaaacagagaacacaatttccctacacgatattgatgtgatcaattcagtntcacatggatatcttgccgtgttttcaggcgataccggggaaatcaagaatgaagtgcgcgaacaaatcaacaaaaaggtgatggaatggcgtgaanagnnnnangcnnanntgntnccnggcgtnctnttnntngangangngcacatgctngacntggagtgcttcncnttcctnnanngnnnnntngagtccganntgnnnccnatnntngtgntngcnacaaacngnggnnnngtnaanatcngcnnnnccnnnnnnnnnncannnnanggaatnccntngganttgntcgaccgcnnnctnatcntnnnnaccannnngtacnncnnngangaaatgtccttggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 285 - DNA, 645 bp, Artificial Sequence
  Description of Artificial Sequence: Synthetic polynucleotide
  modified_base (279)..(279): a, c, t, g, unknown or other
  modified_base (301)..(303): a, c, t, g, unknown or other
  modified_base (343)..(345): a, c, t, g, unknown or other
  modified_base (643)..(645): a, c, t, g, unknown or other
atgggacgtcgtccagctcgctgctatcgctacatcaagaacaagccgtacccgaagtcgcgcttttgccgaggtgtgcccgacccgaaaattcggattttcgacctgggaagaaagcgtgccaccgtggatgagttcccgtgttgtgtgcacatgatatccaacgagcgcgaacatctctcatctgaggcacttgaagccgcccgcatttgcgccaacaagtacatggtgaagaattgcggcaaggatggcttccacatgcgcgtccgaatccatccnttccacgtgatccgcatcaacnnnatgttgtcgtgcgctggcgctgatcgactccagaccggannncgtggcgctttcggcaaaccgcaaggactggttgcgcgtgttgccatcggcactgtgctcatgtctgtgcgcgttcgtgaccagcaccaagcacatgctttggaggcattccgtcgggccaagttcaagttcccaggccgccaatacatcattgtgtcgcgcaaatggggcttcacccagttcgaccgcgaagtctacgagaagtaccgcaaagagggccgagttgtgccggatggtgtgcactgtaagctcgtcaaggaacatgggccgctgaccgagtggatcaagaacccaatcnnn

SEQ ID NO: 286 - DNA, 1221 bp, Artificial Sequence
  Description of Artificial Sequence: Synthetic polynucleotide
  modified_base (1)..(57): a, c, t, g, unknown or other
  modified_base (289)..(291): a, c, t, g, unknown or other
  modified_base (490)..(490): a, c, t, g, unknown or other
  modified_base (495)..(496): a, c, t, g, unknown or other
  modified_base (606)..(606): a, c, t, g, unknown or other
  modified_base (768)..(768): a, c, t, g, unknown or other
  modified_base (1219)..(1221): a, c, t, g, unknown or other
nnnnnnnnnnnnnnnnnnnnnnnnnnnnnnnnnnnnnnnnnnnnnnnnnnnnnnnnngatgacaaaaatcgagccttggctgcatatcgtcgcaagttgacggaatacaaagagatcgaaaaccgactcaaggaccttcgcacaaaagagcgagaagaccagcaaaagtccgacaaatcggaaaatgacatccgcgctttgcaatccgtgggccaaattgtgggcgaagtgctcaagcaactgaccgaggagaaattcatcgtcaaagccaccaatgggccgcgttacnnngttggctgtcgtcgatccattccgagggagaagctgaagcaaggaacgcgcgttgctctggacatgaccacgctcaccatcatgcgccaacttccccgcgaagtggaccctttggtgtacaagatgagccacgaagatcccggcaatatcagttatgccgaaattggcggactttctgagcaaattcgcgaactgcgcnaggtnnttgagttgccattgataaatccggaactgttcaagcgtgttggcatcacgccgcccaagggttgcctgctctacggaccgccgggcacaggcaaaactttactggccagngccgttgcttcccaattggactgcaatttcctgaaggtggtctcttcggccattgttgacaaatacattggcgaatcggcgcgcatgatccgtgaaatgttcaactatgctcgcgaccatcagccttgcattgttttcatggacgaaatcgacgctatcgcnggtcgacgcttttccgagggcacttcggccgatcgggaaatccaacgcaccctcatggagttgctcaatcaaatggatggctttgattcattgggcaaagtgaagatcatcatggccacaaatcgtcccgacaccttggacccagctttgcttcgcccgggccgccttgatcggaaaatagagattgccctgcccaatgaacagagtcggcttgagatcctgaaaatccacgcaagcaaaatcaccaagcaagagccgattgattacgaagccgtggtcaagctgtccgagggcttttccggtgccgatctccgcaatgtttgcaccgaggccggactgaatgcaatcagaaaggagcgggagtacgtgatccaggaggactttatgaaagcggtgcggaaagtggcggatgcgaagaagctggagaccaagctggactacaagcctgtcnnn

SEQ ID NO: 287 - DNA, 1683 bp, Artificial Sequence
  Description of Artificial Sequence: Synthetic polynucleotide
  modified_base (310)..(312): a, c, t, g, unknown or other
  modified_base (459)..(459): a, c, t, g, unknown or other
  modified_base (582)..(582): a, c, t, g, unknown or other
  modified_base (682)..(1683): a, c, t, g, unknown or other
atgggaaaaggattccagaattttatgtccaagaaggactttcatccaagtgcatggtggaatctaaaaagaaaatgggaagcggaacagaaagacgaaatggaaaagaagaaacaagaagaacttcgtgtgcaatatcaaaaggagcaggaaatgttcaacaataaggcccttctgggtgatgagaaagcccggcttggactctcattcatgtacgacgctccagctggaatcaacaagaagaaggaagaagggcctgaaccgaaattcgagtggcaacgaaaatacaatgcaccaagagaggattggnnnaaaggaaatgagctgatccaggatcaaccatttggcatccaggttcggaatgttcgctgtgttaaatgtcgcacttggggccacttgaacactgaccgagaatgtcccctctttgggatgagtgggaattcagaaaatcatggattngcaaataaaccatcggatttgatccgggaattgcattcatcggcgaaggcttccacttcgagagacccaaacgctccttcatcatcacaaatgaaatacgaagtaaaggaagaagaaaagagnccaattgaccaggaacaattgctggaagacatgcgcgaggagcataacctgaaattcaagagtggcattctcagcgagctccgtgccgacgagaacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 288 - DNA, 564 bp, Artificial Sequence
  Description of Artificial Sequence: Synthetic polynucleotide
  modified_base (237)..(237): a, c, t, g, unknown or other
  modified_base (294)..(294): a, c, t, g, unknown or other
  modified_base (502)..(504): a, c, t, g, unknown or other
  modified_base (562)..(564): a, c, t, g, unknown or other
atgactaaagtccattactgcaagcggcccgacaacaccacaaagtcgtgcaaagcccgcgggtcggatctgcgtgttcacttcaagaacacgcacgaaactgctcgcgcgatcaagcatatgccgctgaagcgtgccgtccgtttcttggagaacgtcaaggagaagaaggagattgttccgtttcgccatttcaagggaggtgttggccgcaaggcgcaggcaaaggcttggganaccactcaaggacgttggccaaagaaatcggctgaattccttcttcaactcctgagnaatgcggagagtaacgccgaagtcaaaggcctggatgttgaccatcttgtcattgaccacatcgtagtccaagcggctgccaagatgcgccgacgcacctatcgtgcacatggacgcatcaatccgtacatgagctcgccgtgccacatcgaggtgattttgaccgagaagaaggaggttgttgctaagccagccggagagattgtcnnnaaagtcaagaaggaatccaagaagaaacagcgacgccagctggcccgtggcgaatatnnn

SEQ ID NO: 289 - DNA, 3627 bp, Artificial Sequence
  Description of Artificial Sequence: Synthetic polynucleotide
  modified_base (1)..(402): a, c, t, g, unknown or other
  modified_base (601)..(603): a, c, t, g, unknown or other
  modified_base (1033)..(1036): a, c, t, g, unknown or other
  modified_base (1039)..(1040): a, c, t, g, unknown or other
  modified_base (1042)..(1042): a, c, t, g, unknown or other
  modified_base (1044)..(1044): a, c, t, g, unknown or other
  modified_base (1046)..(1046): a, c, t, g, unknown or other
  modified_base (1059)..(1059): a, c, t, g, unknown or other
  modified_base (1074)..(1074): a, c, t, g, unknown or other
  modified_base (1080)..(1080): a, c, t, g, unknown or other
  modified_base (1095)..(1095): a, c, t, g, unknown or other
  modified_base (1104)..(1104): a, c, t, g, unknown or other
  modified_base (1107)..(1107): a, c, t, g, unknown or other
  modified_base (1131)..(1131): a, c, t, g, unknown or other
  modified_base (1137)..(1137): a, c, t, g, unknown or other
  modified_base (1150)..(1150): a, c, t, g, unknown or other
  modified_base (1152)..(1156): a, c, t, g, unknown or other
  modified_base (1158)..(1158): a, c, t, g, unknown or other
  modified_base (1191)..(1191): a, c, t, g, unknown or other
  modified_base (1227)..(1227): a, c, t, g, unknown or other
  modified_base (1386)..(1386): a, c, t, g, unknown or other
  modified_base (1389)..(1389): a, c, t, g, unknown or other
  modified_base (1395)..(1395): a, c, t, g, unknown or other
  modified_base (1419)..(1419): a, c, t, g, unknown or other
  modified_base (1633)..(1635): a, c, t, g, unknown or other
  modified_base (1822)..(2160): a, c, t, g, unknown or other
  modified_base (2341)..(2352): a, c, t, g, unknown or other
  modified_base (2448)..(2448): a, c, t, g, unknown or other
  modified_base (2521)..(3627): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaagtgacatgaccgaagaagagatggaacgctacttccaagagcgacatgctcagcaagccgcggcacaccaaggcgatcttgatgaggatgcttacgacgatatcacacaaaatggtttattgcccagcacaaaggacccaaatctttggattgtcaaatgccgaatgggcgaagagagggccacttgcctcnnnttgatgcgcaaatgcattgcttaccagaacacggatgaaccacttcaaatcaagacagtagttgtcaagcagggtctcaaaggaatgctttacatcgaagcctacaaaaaagcgcatgttgcaaaagccattgagggaatttccgctctgaatcagcaccaaatcacgatggttccaataaaagaaatgccagatacgctgaaagttgtcaaagacacgcctactttgaaggccggatcttacataagaatggctagaagtctttacaaggatgatttggcccaagtggattacgtcgatattgctcagaaccgggtgcacttaaagcttgtcccccgaattgattacacgcgactcagaggagctctcaaaaatcaggaaaatcgccctctccgcaacaaacgtcgtcccttgccagcaccatttgatnnnnatnntntnanagcaatcggcggngatgtgacaaatganggcganttttacatatttganggtggacantanagacgcggttttctgtacaaggcntttccnatgaatgcaattntnnnnnanggagtgcgaccttctctaacagagcttgaacgnttccaagattctgcagaagatctaaagaaagaatgngaaaacactcatctccgtgagaagcgtcacaattttgcacccggtgataatgtggaagtcactgatggcgagttggttaatttgcgtggtaaaattcaaagcattgatggcgacaaagtggtcataatgcctgaccatgaggatcttaatgaaccattnacnctgaangcttatgaactccgaaaatacttnaaagctggcgaccatgttcgcgtcattggtggccgatatgaaggtgacactggattgattgttcgggtggaggacaacatggtcattctgctatccgatcttactatgggagagatgaaaattctgccgaaagatgtccaattgtgcacggaagttgcgactggagtcgagcgaatgggccaatatcaataccaagaccttgtgatgctggatnnnaaagacacggtcggggtcatagtgcgcctggaacgagagcatgtggaagtgcttaacatgcatggcaaattggttcgcataaatccacagacaatcgagagcaagaggaattcacgccttatgaaagcattggatgcgcaaaagaacacaatccaagtgggcgacatggtcaaagtggtggagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagacaaacagtgcgacgaaacatggcaatgattggaaagactgtccgaattcgggccggcccaatgaaaggttacatcggaattgtgaaggatgctactgaatcaacagtgaaagtcgaattgcacacaatgcccaagactgtgaattttgacattgataaagttatggaagttggtnnnnnnnnnnnnacagctggtggagccacacccggctttatgggtgcatctggccgaacaccgatgtacggaggcgctcaaacgcccatgtatggtggtggtgttttnttagttggatccagtacacctcattatggctcgatgactccggtttatgatggaagtcgcacgtcttcgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 290 - DNA, 3735 bp, Artificial Sequence
  Description of Artificial Sequence: Synthetic polynucleotide
  modified_base (1)..(504): a, c, t, g, unknown or other
  modified_base (601)..(1071): a, c, t, g, unknown or other
  modified_base (1230)..(1230): a, c, t, g, unknown or other
  modified_base (1371)..(1371): a, c, t, g, unknown or other
  modified_base (1444)..(3198): a, c, t, g, unknown or other
  modified_base (3319)..(3735): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgacttccacaaattgatattttcattggtcagtggcctaccaaacgaagtctcatttggactgaatatctgtgtgataatgtctcatcctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattggacacagcaacacaccgtgtgcttatcagaaccattaaaaacgggttggaatccaacgacaagatgacacttttgcgttccatggaaatattagccggacttagtcatttgcttgtgaacgaatcaacaatttatgaattttggatgatgcgngtaatgcaacgaatatttacgcttctttctctcaaagacattttgatttgcattgtttgcctggaaacaattttacaaatttctgaattgggcaaaacatcttgtgaattgatcagtacacataatagtgcgatagaaagnctggttggaatgctgacaacggatgcagcctccttcggtcaagcaggtctctttggaatcaaagtcgtagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagattccgaaggcccagtcacgcgtaatttacgactcacatcaacactgattttaagaaatatttgtacacactctgttacgggacgaaagaagttaagaaaattcgagggatttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 291 - DNA, 2406 bp, Artificial Sequence
  Description of Artificial Sequence: Synthetic polynucleotide
  modified_base (1)..(294): a, c, t, g, unknown or other
  modified_base (423)..(423): a, c, t, g, unknown or other
  modified_base (558)..(558): a, c, t, g, unknown or other
  modified_base (1009)..(1212): a, c, t, g, unknown or other
  modified_base (1414)..(1416): a, c, t, g, unknown or other
  modified_base (1431)..(1431): a, c, t, g, unknown or other
  modified_base (1549)..(2055): a, c, t, g, unknown or other
  modified_base (2199)..(2199): a, c, t, g, unknown or other
  modified_base (2302)..(2304): a, c, t, g, unknown or other
  modified_base (2380)..(2406): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacgtcagcttgcttcttcattggatacgctatcaggacttgcgcaaaatatatctgggcgtgttgcagcactggatttgggaaaatgtcgtgtggtggaatgccttcaacgcgtgaatgatttgaangatttgggcacatgcgcaagcggcgtccaagaggctatgaaaattgaaaactacgaagaagctgcaaggcatattcatagatttttgacgttggattcggccgttttcaaaatgggagatcatcccgagaaagtngctggctattccgtcaagaacagctatgaagtgctacgacaagccacaaacgagttgaaagcagtgattgaatccaaatttgatgaggcaaaaacaaagggtgaccttgctgccatggaacgctttttcaaactttttccgttgattaacgaacaccaaaaggggctgaaaagattcggtgcttatctcagtgtgaaaattaccgaaattggggagcagaattaccggataatgcaagctggtggaacggacgacaatcggcggaatgtcctttttgctgacacattgacgatgatttttgagggtatcgcccggcttattgaagtgaatcaaccgattgtggagaacttctatggccatgagaagttgctggatttgatcgagtcaatccaaccggaatgcgatcggcaggcgggccgcgttcttgaagcattcatacagaagaggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagtgaggaccaaaggcgggaatatttggaacgattgaggaaaaaccgagaagaaagagcaaagaaattggatttggtgctgaacaggtcaagactgaacaccagaatgcaggaattgcttggcaaatatgttctgatggaacagtattacatgacccaatcggtgcagaaagcgattgccatggacactgttgaggatnnnggcgcgcaaacaagntctcttctggatgatgttttctttattgtgcgcaaaagcattcggcgttctatcagctcatcttctgtcgattgcatttgcgcaatgctcaacaatggggtcactttgttggaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaatctactttcttccgtttctggcgaagcagtgcaacaaatcgagcgagttattttcaaatgctccttcaaccggcttggtgccttgcaacttgacaaggaattgcgcgagttaacaacttatttgacttcaattacaatnttattaaatacaaacttctaatagaaaatcattcaggtgataactctgctgaacgtggaaaatctcgatgatgcgcaaaatctgctccagcaactacaaagcnnnaactcattatcccaagcacccatgctgtccaacagtgatatccgacgaatattgaatttgcgcgaagaattcccannnnnnnnnnnnnnnnnnnnnnnnnnn

SEQ ID NO: 292 - DNA, 1278 bp, Artificial Sequence
  Description of Artificial Sequence: Synthetic polynucleotide
  modified_base (1)..(93): a, c, t, g, unknown or other
  modified_base (201)..(201): a, c, t, g, unknown or other
  modified_base (330)..(330): a, c, t, g, unknown or other
  modified_base (631)..(633): a, c, t, g, unknown or other
  modified_base (1108)..(1110): a, c, t, g, unknown or other
  modified_base (1182)..(1182): a, c, t, g, unknown or other
  modified_base (1258)..(1278): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggaaattatgcaagcattcacagcagcggctttcgtgatttgatgctccgtccggagcttcttcgcgcaatcattgattgtggtttcgaacatccatcagaatgncaacacgaatgcatcccgcaagcaattttgggcatggatattgtctgccaggcgaaatctggaatgggcaaaaccgccgtttttgttctggcaacactgcaacaattgacgccaatagatggaacatcntctgtgctggtcatgtgccacactcgtgagctggctttccaatctcaaaggaagtatgaacgcttcagcaaatatatgcctggagtcaaggtttctgtcttcttcggtgggatgcccatcaagaaggacgaagagaccctcgccaagaacacaccgcacatcgtcgtgggcacgcctggacgtttgctggcattgggacgtacgggacacttgaagctgaagaatgtgaagttctttgtgctggacgaatgcgacaagatgatcgggatgctggatatgcgccatgatgtgcaggagattnnnaagatgacgccgcaagagaagcaggtcatgatgttcagcgccacactcccacgtgaactacgcgtcgtctgcaagaaattcatgcaagaaccaatggaggtgtacgttgacgacgaagccaagctcactcttcatggtctgcaacaatactacgtccgactgaaggaaaatgagaagaatcgcaaactcttggatttgctcgatgctttggagttcaaccaggtcgtcatctttgtccgctccgtgagtcgctgccgtgccctcaaccaactgctgattgaacaaaacttcccgtccattgccatccaccgtgcaatggcccaagaggagcgtctggggcgttaccagcaattcaaagacttccagaagcgcatccttgtggccaccaacctatttggacgcggaatggacatcgagcgcgtgaacatcgtcttcaattatgacatgccggaagacaccgacacctatttgcacnnngttgcacgtgccgggcgttttggaaccaagggacttgccatcacattcgtttcggacgaaacagatgcccanacactgaacagtgtgcaagaccgcttcgacgtgaccatctcagagctgcctgatcagatcgacgtgggcacctatnnnnnnnnnnnnnnnnnnnnn

SEQ ID NO: 293 - DNA, 963 bp, Artificial Sequence
  Description of Artificial Sequence: Synthetic polynucleotide
  modified_base (132)..(132): a, c, t, g, unknown or other
  modified_base (291)..(291): a, c, t, g, unknown or other
  modified_base (414)..(414): a, c, t, g, unknown or other
  modified_base (499)..(963): a, c, t, g, unknown or other
atggctaaccgaacagctcgggatgcgcacacagtcaagggcaccaatccgcaatatttgattgagaaaattatccgtacaagaatttacgactctgtctactggaaagaacaatgctttggactttcaggngagacaattattgaccgtggcatggaattgcgcttcattggcggcatttatggcggaaatatcaagccatctccattcctttgccttattctgaaacttctacaattgcagccagagaaggatatcatcattgagtttatccgccaagatgatttcaantacattcgcgcattgggtgcaatgtacattcggctcgtgtttggttcggtggaagtatacaagtaccttgaaccgctctacaatgactaccgcaaattgcgctacatgaacagggctggagtntttgaactgctccatatggacgagtttattgacaatttgttacgcgaagaccactactgcgatattcagctgcctcggcttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 294 - DNA, 2652 bp, Artificial Sequence
  Description of Artificial Sequence: Synthetic polynucleotide
  modified_base (1)..(96): a, c, t, g, unknown or other
  modified_base (349)..(349): a, c, t, g, unknown or other
  modified_base (375)..(375): a, c, t, g, unknown or other
  modified_base (387)..(387): a, c, t, g, unknown or other
  modified_base (396)..(396): a, c, t, g, unknown or other
  modified_base (411)..(411): a, c, t, g, unknown or other
  modified_base (423)..(423): a, c, t, g, unknown or other
  modified_base (441)..(441): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (513)..(513): a, c, t, g, unknown or other
  modified_base (516)..(516): a, c, t, g, unknown or other
  modified_base (546)..(546): a, c, t, g, unknown or other
  modified_base (552)..(552): a, c, t, g, unknown or other
  modified_base (559)..(559): a, c, t, g, unknown or other
  modified_base (561)..(561): a, c, t, g, unknown or other
  modified_base (563)..(565): a, c, t, g, unknown or other
  modified_base (567)..(567): a, c, t, g, unknown or other
  modified_base (569)..(570): a, c, t, g, unknown or other
  modified_base (606)..(606): a, c, t, g, unknown or other
  modified_base (765)..(765): a, c, t, g, unknown or other
  modified_base (870)..(870): a, c, t, g, unknown or other
  modified_base (1089)..(1089): a, c, t, g, unknown or other
  modified_base (1092)..(1092): a, c, t, g, unknown or other
  modified_base (1122)..(1122): a, c, t, g, unknown or other
  modified_base (1146)..(1146): a, c, t, g, unknown or other
  modified_base (1153)..(1153): a, c, t, g, unknown or other
  modified_base (1198)..(1200): a, c, t, g, unknown or other
  modified_base (1243)..(1245): a, c, t, g, unknown or other
  modified_base (1485)..(1485): a, c, t, g, unknown or other
  modified_base (1684)..(1857): a, c, t, g, unknown or other
  modified_base (2005)..(2421): a, c, t, g, unknown or other
  modified_base (2605)..(2652): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacaccaaaaattccacagactcgtgcattcaatgagacgccggtgaatgcccgcaagtgccgaccaatcatttgcaagctgctctacctgctgcaacatggcgagaccattggcaaaaccgaggccaccgacacgttcttcgccatcaccaagctgtggcaagccaaggatgtgacgctgcgaatgctggtctacctggccatcaaggagctgtccagcatttcaagcgatgtgatcattgtgaccagcngcctcacaaaggacatgaccggccgngaggacatctancgtccgtcngcaatccgcgccctntgccgaatcctngacaccggcatgttgcanggcattgagcgctacatgaagcaggccattgtcgataaggttccgcccgtttcntcngccgcnctggtctcntcnctgcacttgatgaagcgaaatcctgaattngtccgncgttggncnannnangnncaagaggcggtctcctcggacaaccacatggtccanttccacgcgctcagtctgctctaccaaattcgcgccaacgatcggctggccatcctgaagatggtgcaaaagttcagcaagtccgggcttcgctctccgctcgccatctgctatctgattcgcattgcggccaaactggttgaggaggatgatggaggngatcgcgttccataccaattcattgagagctgtttgcgcaacaagcacgagatggtcatttatgaggcggcatcggcaattgttcgtctgccgcgtatttctcgnggagaacttgcctcggccgtgagtgttctccaacttttcctctcctcaccaaaaccggccctgcgctttgctgctgtgcgcaccctgaacaaaatctccatgaactacccgcaagccgtgatttcgtgcaatgtggacctggagcagttgatcaccgaccagaaccgttcaattgccacgctggcaatcaccacactgttgaagaccggggccgaggcntcngtggagcgactgatgaagcagattggcacntttgtcagtgagatcagcgatganttcaagnttgttgtgatcgaagcaatccgctcgctgtgcattcgctaccccnnnaagcacgccaccctgatgaacttcctggcccaaatgctgcggnnngagggcggcttcgagtacaagaaggccattgtggacaccatcatctgcattgtggaggacaacccggccgccaaggacctgggcctctcccacctgtgcgagttcatcgaggactgcgaacacgcggcgctggccacccgggtgctgcacttgctgggccgggaggggccgaccaccaacaatcccgcccgctacatccgcttcatctacaaccgcgtcattttggagagtacacaggtncgagccgcagccgtcacagcgctggccaagttcggtgcggagtgtccccaactgcgtcccagcattgtcatcctcctcaagcgctgcctgctggacacggacgacgaagtgcgcgaccgggccaccttctatctgtccatcctgcgaagtgacgaccagaatgccattgtgcgatacattctggacacgttgaaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcagaacaaatcgcggcaatccccgaactggcacaaatcggcccactgttcaagtcgtcgcccagctttgatttgaccgagaccgtgacggagtacaatgtggcctgcgtgaagcacattttcaatgatcatctgctgctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacctgcagaaatgcattggcctctacccggccgagcattccgaccgtgtccaagagggcaaatccatgcacaccctgatgatgtccggcgtgttccggggcggtattgacgtgctgtgccgcataaaaatggcgctggaccctgtggaccagcaggttaccatcaatctggttgtcaggnnnnnnnnnnnnnnnnnnnnnnnnnnnnnnnnnnnnnnnnnnnnnnnn

SEQ ID NO: 295 - DNA, 636 bp, Artificial Sequence
  Description of Artificial Sequence: Synthetic polynucleotide
  modified_base (1)..(156): a, c, t, g, unknown or other
  modified_base (324)..(324): a, c, t, g, unknown or other
  modified_base (462)..(462): a, c, t, g, unknown or other
  modified_base (538)..(636): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaggttgacgggaagacggtaaaagcccaaatttgggacaccgcaggccaagagcgctaccgggcaatcacttcggcttactaccggggcgctgttggtgcactcctggtctacgacattgccaagcatgtcacctacgagaatgtcgagcgatggcttaaaaanttgcgcgaccacgcggaccagaacattgtgatcatgttggtgggcaacaaaagtgacttgcgccacttgcgggcggtgccaacggaggaggcgcgcgcatacgccgagcgcaaccagctcagcttcatcgagacccgngctttggattccaccaatgtggaggccgcgttcaccaacattctaaccgagatctaccgttccgtcagcaccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 296 - DNA, 2895 bp, Artificial Sequence
  Description of Artificial Sequence: Synthetic polynucleotide
  modified_base (1)..(675): a, c, t, g, unknown or other
  modified_base (718)..(720): a, c, t, g, unknown or other
  modified_base (846)..(846): a, c, t, g, unknown or other
  modified_base (966)..(966): a, c, t, g, unknown or other
  modified_base (984)..(984): a, c, t, g, unknown or other
  modified_base (1161)..(1161): a, c, t, g, unknown or other
  modified_base (1416)..(1416): a, c, t, g, unknown or other
  modified_base (1455)..(1455): a, c, t, g, unknown or other
  modified_base (1463)..(1463): a, c, t, g, unknown or other
  modified_base (1503)..(1503): a, c, t, g, unknown or other
  modified_base (1518)..(1518): a, c, t, g, unknown or other
  modified_base (1577)..(1578): a, c, t, g, unknown or other
  modified_base (1791)..(1791): a, c, t, g, unknown or other
  modified_base (1821)..(1821): a, c, t, g, unknown or other
  modified_base (1833)..(1833): a, c, t, g, unknown or other
  modified_base (2293)..(2304): a, c, t, g, unknown or other
  modified_base (2442)..(2442): a, c, t, g, unknown or other
  modified_base (2829)..(2829): a, c, t, g, unknown or other
  modified_base (2890)..(2895): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatatcaacgcgaattagaagcacttgagaaggaaacaaaannnttaaagcaaaggctactcctcaaagatgctggtgaattgaagagacaaagaaaaatcaagcgctccctcattgaaatttattcggaaatgttggatatcctcattgaatatgattcttcttatggnactgcggataatttgccaagagtggttgttgttggcgaccagtcggccggcaaaacctcggttcttgaaatgattgcccaggcaaggattttcccacgtggctccggtgagatgatgacncgggcacctgttaaagtnacactcagcgaaggcccataccatgttgcccaattcagggatagcaaccgagaatttgacttgacaaaggaatctgatcttcatcaattacgcaatgaaattgaattgagaatgaggaattcagtcaagggtggccgcactgtttcgaatgaagtgatctctctcacagttaaaganccatctctgcccagaatggtgttggttgacttgccaggcgtgatttccactgtaacaaccgacatggcaaaggacacgaaggatgacattgtgaagatgtgcaaaatgcacatggagaatccgaacgccatcattctttgcattcaagatgggtctgttgatgccgagcgtagcaatgtcactgatttggttagcagcgtggatccggatgggcaaagaacaatccttgtcttgacaaaagttgatttggctganaagaatttgagcaatcccgacagaataaagaaaatcctngagggtcngctctttccaatgaaggcgcaaggctattatgcagtggtnactggcatgggaacnaaagacgccaacattggagacattcgcagatacgaggaggaattctttgaaaattccannctcttcagggatggcgttttgaaggccacccaaatgaccacaaggaacatgtcgatggctgtgtctgattgcttctggcgaatggtgcgcgaatcgatagaggcccaggcagatgcattccgagcaaaccgtttcaatctggaaacggaatggaagaacacatttacgcaccagagggacttgaccagggatgaactttttgaaaaggcgagnggtgaaattttggacgagattgtcaacctntcgcaagtttcngccgacgaatgggaacaacttctgagagcctatctctggaatgccatctccatctatgtgttcgaccaaattctaatgcacgcctcttccgtggacaacgcaggcacttttaacacgctcattgacataaaactcaaacactgggccgagaaggaattggctaacagatctgttcaggttggatgggaggctctttcgcaaatattcagacgtcaagtggaaggaaatgacaagcgaagaaatgacaaggaagagctgttgacacccttgaaaaaagccgttgttgaagtagcactttctcagcacaactgggatcccaaggctctggattatttgcgtgtaattcaattaaatgctgttgcggaccagattgtgccggatagaagagcatgggaacaatcttgcgagttcatggcaaaggctgccagtgatcgtttgcaggagcttaagaaggcacttnnnnnnnnnnnnggaccttcaacatttgccagctggttaacatggagttcagcaacagccgagcaacggatcaatcaggcacttcaggatgaattgcatgccatccttatcacaaatccagaacacaaacagtcattgttcgacgatgtnttgacggtggttaagcgcaatctggagtcgaagcaagttagcgagttgacaaatgagcagattctcaaacaatggcgattgatctaccgacaacacttcctggaacgaattctacaagcgagtcgtgattgcttgagtttttaccaaaattacaagcaaggcatcagactagactcggatttggactgtcaaatggtggtgttcttctacagaattaacagaatgctggacctgagttgcaatgccctgcgccagcaaattgttaacacagagcagagaagactagaaaaggaagtcaaggagatattgaatgattggtcccaggataacgagaagaagaagcagtatttgacaggacgacaggttgagctggccgaagaattggancaagttcgatatatacaagagaagcttgaggaattcataatccagctgcatcaggagaagnnnnnn

SEQ ID NO: 297 - DNA, 570 bp, Artificial Sequence
  Description of Artificial Sequence: Synthetic polynucleotide
  modified_base (312)..(313): a, c, t, g, unknown or other
  modified_base (315)..(316): a, c, t, g, unknown or other
  modified_base (318)..(320): a, c, t, g, unknown or other
  modified_base (322)..(326): a, c, t, g, unknown or other
  modified_base (328)..(328): a, c, t, g, unknown or other
  modified_base (330)..(330): a, c, t, g, unknown or other
  modified_base (348)..(348): a, c, t, g, unknown or other
  modified_base (396)..(396): a, c, t, g, unknown or other
  modified_base (411)..(411): a, c, t, g, unknown or other
  modified_base (414)..(414): a, c, t, g, unknown or other
  modified_base (420)..(420): a, c, t, g, unknown or other
  modified_base (441)..(441): a, c, t, g, unknown or other
  modified_base (468)..(468): a, c, t, g, unknown or other
  modified_base (556)..(570): a, c, t, g, unknown or other
atgaagctgattgaatcaagcgacactgtcaagttcccggagggcgtcaaattctcgctgaagaaccgggttgtgaaggtgaccgggccacgcggcactctgactcgagacttccgccatctcaacattgagatcacccaggagggtgcaaacatgctgcgcgtccgcaaatggttcggcattcgcaaggagttggccgcaatccgcacggtttgctcccacatcgagaacatgatcaagggagtcacgcatggattccgctacaaaatgcgttccgtctatgctcatttcccgatcaacatcacgctgcannannannncnnnnntntncagatccgaaacttcctnggcgagaagtttgtccgtcgcgtcactctgccccaaggcgtctcggcngcaatgtcgaccaancanaaggangagctgatcattgacggcaangacgtgcagaaagtgtcgcaagcacgngctcgcatccaacagtcgaccaccgtgaagaacaaggacatccgcaagttcctggacgggatctacgtgagcgagaaagtgaccgttnnnnnnnnnnnnnnn

SEQ ID NO: 298 - DNA, 3465 bp, Artificial Sequence
  Description of Artificial Sequence: Synthetic polynucleotide
  modified_base (1)..(66): a, c, t, g, unknown or other
  modified_base (234)..(234): a, c, t, g, unknown or other
  modified_base (543)..(543): a, c, t, g, unknown or other
  modified_base (733)..(936): a, c, t, g, unknown or other
  modified_base (1059)..(1059): a, c, t, g, unknown or other
  modified_base (1176)..(1176): a, c, t, g, unknown or other
  modified_base (1329)..(1329): a, c, t, g, unknown or other
  modified_base (1477)..(1482): a, c, t, g, unknown or other
  modified_base (1641)..(1641): a, c, t, g, unknown or other
  modified_base (2334)..(2334): a, c, t, g, unknown or other
  modified_base (2515)..(2610): a, c, t, g, unknown or other
  modified_base (2730)..(2730): a, c, t, g, unknown or other
  modified_base (2862)..(2862): a, c, t, g, unknown or other
  modified_base (3147)..(3147): a, c, t, g, unknown or other
  modified_base (3463)..(3465): a, c, t, g, unknown or other
nnnnnnnnnnnnnnnnnnnnnnnnnnnnnnnnnnnnnnnnnnnnnnnnnnnnnnnnnnnnnnnnnnatgcatctgaaagacaaatcagaattgataccttcatttcttaaaacaaaaggacttttcaatcaacacatcgcaagcttcaattatttcattgatacggaaatccgtaacattgtgcatgtcaacaataaaatcacgagtgatgcgaatcctgccttttatttgaantataccaatataaacattggagcaccatcaagtgaggaaggcttcaacatagtcaatgataagataacgccacacgaatgcagactccgtgatatgacatactcagcaccaatctatgttgatgtggaatatacgagagggaatcagaaggttgttagcaagaaaatcctcattggccgaatgcctgtgatgctacgttcttcacgttgtattttatccaaattaacggaagagcaaatggcccatgcgaatgaatgcccctatgatccagggggctactttataattcggggcaccgagaaagttgtnttaatgcacgagcaaatttctcgcaatcgcataatgatcaatcggaacatcaagaaggaattgatctgcgaagtgctgagcacaagccaagacaggaagagtaaaacctatataattagcaaaaaaggacatttctacctcaaacacaaccaattgactgatgacattccggtcgctgtaattttcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagagtttcacaagaacacgatgttttggattttttgagcaattccatgattggacatgttttatcgccgggtggcaatatgaagatgaaggcactttatataggattgatgattagaagncttatacaagcggaaaagggtctttgtgaagcagacgaccgggatttctatggaaataagcgaattgaattggccggctctttgttggcacttctttttgaagatttgttcaaacgntttaattccgaactgaaaagaatagctgacagtcatttgggcaaaaatctggcagccccactggacataattcgtcatatgcgccatgatttgataacaaacgggttaataaatgcattgtccacaggcaattggagtataagaagatttggnatggagaggcaaggagtcacacaagtgcttgctcgacactcatatatcagtgttttggggatgatgactcgaataaattccacatttgaaaagacaaggaaggtgtcaggcccccgatcacttcagtcttcgcaatgggttttgcttnnnnnnaaagacacacccgaaggcgactcatgtggtcttgtgaaaaatttagccctgttaagtcacataacaacggacagtgatgaaaccccaatattgagacttctctacaattgtggaatgcaagatttgcggccactcaaattcagtgcaattcacaatccnaaatataatttggttttcctcaacggatcgattgttggtctcacagatgacatccaacatattttgcaaaccatcagaatgctgagacgaaagaatttgctggacccatttgtttcggtcagcatcaacaattccaccaatgcgatttacctagcaagcgatggggggagactttgcaggccttacattattgtggagaagcaaattcctctgctaacacaggatcaaattgaggatgtgaaatatggattgaaaacgtttgatgatctgattgccgaaggctgcattgaattccttgatgtcaacgaaatcaacaatgcacaaattgctgtctatgagaaggatattgttgcgcaaacaactcatctagagattgaacctttttcgctgcttggtgttgtggccggactcattccatatccacaccacaatcaaagtcctcggaacacctaccaatgtgccatggggaaacaagcgatgggcacaattggatacaaccaacagaagaggatagacacgctgatgtatttgattgtgtatccacaaaagccgctggtgaagacaaaaaccattgaattgtcaaattttgaaaaattgcctgccggacaaaatgcgattgttgcagtgatgtctttcagcggttacgacattgaggatgcgcttgtcttgaataaagcatcattggatcgagcntttggacgatgtatggtctacaaattcaacaaaggcaccgcaaggaaatatcccaatcaaacatatgacaaattgatgggcccttcactggatgcgcaaaccaaaaagccaattgccaaacatgcaattttggacagtgagggcattgtgtttgctggtgccaagatattgcccaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacaaaggatgtggctgtcacctaccgaggaccattggatgccactgcagagagagtgatgctgacatgcaacgaggaggagcaatatttggtcaaggtggtgatagcccaatgcagncgacccgaactgggcgacaaattcagcagtaggcacggtcaaaagggtgtttgtgggctaatatcgccacaggaggacatgccttttgatgaaaatggaactgttcccgacctgatcatgaaccctcacggntatccaagccgtatgactgtgggcaaactgatggaactgctcagtggcaaatgcgcattgatgaattggcggcttcattatgggactgcatttggcggagatgacatggaaactgtaagccagcaaatggcccaacatgggtacaacttccttggcaaggacatgctcacatcgggcatcacaggacaacaaatggctgcctacatctattttgggcccatctattaccagaagttgaaacacatggttgtggacaaaatgcatgccagagccaagggaccaagngcgatactgacacggcaaccaaccgaaggaagggcccgggaaggaggactccggcttggtgaaatggaacgcgactgtctgattgcgtacggggcatcaatgttgctgatggagcgattgatggtctcctcggatcaatttacggttgatgtctgcacagaatgtggtctgatggggtacagtggatggtgccaatattgcaaaacttctgcttccatggccaagatcaaaattccatacgcctgcaaactgttattccaggagctacaaagcatgaacatagtgccgcgtctccagacatccaaatacatagatnnn

SEQ ID NO: 299 - DNA, 957 bp, Artificial Sequence
  Description of Artificial Sequence: Synthetic polynucleotide
  modified_base (1)..(15): a, c, t, g, unknown or other
  modified_base (606)..(606): a, c, t, g, unknown or other
  modified_base (955)..(957): a, c, t, g, unknown or other
nnnnnnnnnnnnnnncccagaggcgaaatgatcagccgggagttcatcaaggagttggacgaatggattgcgcaactctacgagtgcaagcagctcagcgaaaaccaagtgaagcaactctgcgacaaggctcgcgaaatcctgaagcaggaatccaacgtgcaagaagtgaaatgcccagtgaccgtttgcggcgacgtccatggccaattccacgacctgatggagctgttcaagatgggcggcaagtcaccggacaccaactacttgttcatgggcgactacgtcgaccgaggctactactccgtggagaccgtctcgctgcttgtctgtctcaaggttcgctaccgggaccgcgtcaccattctgcgcggaaaccacgagtcccgacaaatcacccaagtctacggcttctacgatgaatgtctgcgcaaatatggaaattccaaggtgtggaactacttcaccgatctgttcgactatttcccactgactgcactggtggacggacaaattttctgcttgcatggtggcctatcgcccagcatagacaccctggaccacataagatcgctggaacgtcttcaagaggtgccacatgaagtnccaatgtgcgatctgctgtggtcagacccggatgaccgaggcggatggggcatttctccgcgtggcgccggctacacctttggccaggacatttcggagacgttcaaccacgccaatggcatcacattgatctcgcgcgctcatcaactcgtcatggagggctacaactggtgccacgaccgcaacgtggtcacggttttctcggcgcccaactactgctaccgttgcggcaaccaagcggccatggtggagctggacgacgagctgaagtactcattcctccaattcgacccggcaccgcgtcgtggcgagccgcacgtgacacgccggacacccgactatttcctcnnn

SEQ ID NO: 300 - DNA, 5277 bp, Artificial Sequence
  Description of Artificial Sequence: Synthetic polynucleotide
  modified_base (1)..(39): a, c, t, g, unknown or other
  modified_base (114)..(115): a, c, t, g, unknown or other
  modified_base (117)..(119): a, c, t, g, unknown or other
  modified_base (127)..(127): a, c, t, g, unknown or other
  modified_base (136)..(137): a, c, t, g, unknown or other
  modified_base (150)..(150): a, c, t, g, unknown or other
  modified_base (190)..(190): a, c, t, g, unknown or other
  modified_base (192)..(192): a, c, t, g, unknown or other
  modified_base (210)..(210): a, c, t, g, unknown or other
  modified_base (217)..(217): a, c, t, g, unknown or other
  modified_base (237)..(237): a, c, t, g, unknown or other
  modified_base (244)..(244): a, c, t, g, unknown or other
  modified_base (267)..(267): a, c, t, g, unknown or other
  modified_base (270)..(271): a, c, t, g, unknown or other
  modified_base (276)..(276): a, c, t, g, unknown or other
  modified_base (280)..(280): a, c, t, g, unknown or other
  modified_base (282)..(282): a, c, t, g, unknown or other
  modified_base (289)..(289): a, c, t, g, unknown or other
  modified_base (312)..(312): a, c, t, g, unknown or other
  modified_base (353)..(353): a, c, t, g, unknown or other
  modified_base (361)..(361): a, c, t, g, unknown or other
  modified_base (366)..(366): a, c, t, g, unknown or other
  modified_base (371)..(371): a, c, t, g, unknown or other
  modified_base (379)..(379): a, c, t, g, unknown or other
  modified_base (433)..(433): a, c, t, g, unknown or other
  modified_base (438)..(438): a, c, t, g, unknown or other
  modified_base (444)..(444): a, c, t, g, unknown or other
  modified_base (451)..(451): a, c, t, g, unknown or other
  modified_base (460)..(461): a, c, t, g, unknown or other
  modified_base (463)..(464): a, c, t, g, unknown or other
  modified_base (471)..(471): a, c, t, g, unknown or other
  modified_base (474)..(474): a, c, t, g, unknown or other
  modified_base (493)..(494): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (520)..(520): a, c, t, g, unknown or other
  modified_base (539)..(539): a, c, t, g, unknown or other
  modified_base (556)..(556): a, c, t, g, unknown or other
  modified_base (558)..(560): a, c, t, g, unknown or other
  modified_base (564)..(564): a, c, t, g, unknown or other
  modified_base (584)..(584): a, c, t, g, unknown or other
  modified_base (588)..(588): a, c, t, g, unknown or other
  modified_base (592)..(592): a, c, t, g, unknown or other
  modified_base (597)..(597): a, c, t, g, unknown or other
  modified_base (619)..(619): a, c, t, g, unknown or other
  modified_base (633)..(633): a, c, t, g, unknown or other
  modified_base (639)..(639): a, c, t, g, unknown or other
  modified_base (646)..(646): a, c, t, g, unknown or other
  modified_base (657)..(657): a, c, t, g, unknown or other
  modified_base (662)..(663): a, c, t, g, unknown or other
  modified_base (671)..(671): a, c, t, g, unknown or other
  modified_base (675)..(675): a, c, t, g, unknown or other
  modified_base (679)..(680): a, c, t, g, unknown or other
  modified_base (690)..(690): a, c, t, g, unknown or other
  modified_base (693)..(693): a, c, t, g, unknown or other
  modified_base (711)..(711): a, c, t, g, unknown or other
  modified_base (716)..(716): a, c, t, g, unknown or other
  modified_base (747)..(747): a, c, t, g, unknown or other
  modified_base (751)..(751): a, c, t, g, unknown or other
  modified_base (768)..(768): a, c, t, g, unknown or other
  modified_base (771)..(771): a, c, t, g, unknown or other
  modified_base (778)..(778): a, c, t, g, unknown or other
  modified_base (805)..(805): a, c, t, g, unknown or other
  modified_base (810)..(810): a, c, t, g, unknown or other
  modified_base (815)..(815): a, c, t, g, unknown or other
  modified_base (819)..(819): a, c, t, g, unknown or other
  modified_base (822)..(822): a, c, t, g, unknown or other
  modified_base (828)..(828): a, c, t, g, unknown or other
  modified_base (837)..(837): a, c, t, g, unknown or other
  modified_base (855)..(855): a, c, t, g, unknown or other
  modified_base (877)..(878): a, c, t, g, unknown or other
  modified_base (885)..(885): a, c, t, g, unknown or other
  modified_base (887)..(887): a, c, t, g, unknown or other
  modified_base (896)..(896): a, c, t, g, unknown or other
  modified_base (904)..(904): a, c, t, g, unknown or other
  modified_base (923)..(923): a, c, t, g, unknown or other
  modified_base (945)..(945): a, c, t, g, unknown or other
  modified_base (959)..(960): a, c, t, g, unknown or other
  modified_base (963)..(963): a, c, t, g, unknown or other
  modified_base (978)..(978): a, c, t, g, unknown or other
  modified_base (984)..(984): a, c, t, g, unknown or other
  modified_base (999)..(999): a, c, t, g, unknown or other
  modified_base (1013)..(1013): a, c, t, g, unknown or other
  modified_base (1047)..(1047): a, c, t, g, unknown or other
  modified_base (1057)..(1057): a, c, t, g, unknown or other
  modified_base (1062)..(1062): a, c, t, g, unknown or other
  modified_base (1066)..(1066): a, c, t, g, unknown or other
  modified_base (1080)..(1080): a, c, t, g, unknown or other
  modified_base (1104)..(1104): a, c, t, g, unknown or other
  modified_base (1107)..(1107): a, c, t, g, unknown or other
  modified_base (1132)..(1132): a, c, t, g, unknown or other
  modified_base (1143)..(1143): a, c, t, g, unknown or other
  modified_base (1170)..(1170): a, c, t, g, unknown or other
  modified_base (1245)..(1245): a, c, t, g, unknown or other
  modified_base (1287)..(1287): a, c, t, g, unknown or other
  modified_base (1294)..(1294): a, c, t, g, unknown or other
  modified_base (1302)..(1302): a, c, t, g, unknown or other
  modified_base (1321)..(1321): a, c, t, g, unknown or other
  modified_base (1344)..(1344): a, c, t, g, unknown or other
  modified_base (1347)..(1347): a, c, t, g, unknown or other
  modified_base (1353)..(1353): a, c, t, g, unknown or other
  modified_base (1372)..(1372): a, c, t, g, unknown or other
  modified_base (1377)..(1377): a, c, t, g, unknown or other
  modified_base (1400)..(1400): a, c, t, g, unknown or other
  modified_base (1407)..(1407): a, c, t, g, unknown or other
  modified_base (1410)..(1410): a, c, t, g, unknown or other
  modified_base (1425)..(1425): a, c, t, g, unknown or other
  modified_base (1427)..(1427): a, c, t, g, unknown or other
  modified_base (1462)..(1462): a, c, t, g, unknown or other
  modified_base (1473)..(1473): a, c, t, g, unknown or other
  modified_base (1505)..(1505): a, c, t, g, unknown or other
  modified_base (1518)..(1518): a, c, t, g, unknown or other
  modified_base (1527)..(1527): a, c, t, g, unknown or other
  modified_base (1560)..(1560): a, c, t, g, unknown or other
  modified_base (1567)..(1567): a, c, t, g, unknown or other
  modified_base (1581)..(1581): a, c, t, g, unknown or other
  modified_base (1585)..(1585): a, c, t, g, unknown or other
  modified_base (1587)..(1587): a, c, t, g, unknown or other
  modified_base (1596)..(1596): a, c, t, g, unknown or other
  modified_base (1613)..(1613): a, c, t, g, unknown or other
  modified_base (1623)..(1623): a, c, t, g, unknown or other
  modified_base (1640)..(1640): a, c, t, g, unknown or other
  modified_base (1676)..(1677): a, c, t, g, unknown or other
  modified_base (1689)..(1689): a, c, t, g, unknown or other
  modified_base (1702)..(1703): a, c, t, g, unknown or other
  modified_base (1720)..(1720): a, c, t, g, unknown or other
  modified_base (1725)..(1725): a, c, t, g, unknown or other
  modified_base (1729)..(1729): a, c, t, g, unknown or other
  modified_base (1737)..(1738): a, c, t, g, unknown or other
  modified_base (1752)..(1752): a, c, t, g, unknown or other
  modified_base (1812)..(1812): a, c, t, g, unknown or other
  modified_base (1821)..(1821): a, c, t, g, unknown or other
  modified_base (1824)..(1824): a, c, t, g, unknown or other
  modified_base (1831)..(1831): a, c, t, g, unknown or other
  modified_base (1872)..(1872): a, c, t, g, unknown or other
  modified_base (1886)..(1886): a, c, t, g, unknown or other
  modified_base (1950)..(1950): a, c, t, g, unknown or other
  modified_base (1953)..(1953): a, c, t, g, unknown or other
  modified_base (1967)..(1967): a, c, t, g, unknown or other
  modified_base (1998)..(1998): a, c, t, g, unknown or other
  modified_base (2003)..(2003): a, c, t, g, unknown or other
  modified_base (2053)..(2053): a, c, t, g, unknown or other
  modified_base (2099)..(2099): a, c, t, g, unknown or other
  modified_base (2125)..(2125): a, c, t, g, unknown or other
  modified_base (2136)..(2136): a, c, t, g, unknown or other
  modified_base (2139)..(2139): a, c, t, g, unknown or other
  modified_base (2185)..(2185): a, c, t, g, unknown or other
  modified_base (2193)..(2193): a, c, t, g, unknown or other
  modified_base (2213)..(2213): a, c, t, g, unknown or other
  modified_base (2221)..(2222): a, c, t, g, unknown or other
  modified_base (2256)..(2256): a, c, t, g, unknown or other
  modified_base (2304)..(2304): a, c, t, g, unknown or other
  modified_base (2320)..(2320): a, c, t, g, unknown or other
  modified_base (2343)..(2343): a, c, t, g, unknown or other
  modified_base (2346)..(2346): a, c, t, g, unknown or other
  modified_base (2348)..(2348): a, c, t, g, unknown or other
  modified_base (2358)..(2358): a, c, t, g, unknown or other
  modified_base (2365)..(2365): a, c, t, g, unknown or other
  modified_base (2373)..(2373): a, c, t, g, unknown or other
  modified_base (2379)..(2379): a, c, t, g, unknown or other
  modified_base (2384)..(2384): a, c, t, g, unknown or other
  modified_base (2388)..(2388): a, c, t, g, unknown or other
  modified_base (2392)..(2392): a, c, t, g, unknown or other
  modified_base (2410)..(2410): a, c, t, g, unknown or other
  modified_base (2419)..(2419): a, c, t, g, unknown or other
  modified_base (2447)..(2447): a, c, t, g, unknown or other
  modified_base (2469)..(2469): a, c, t, g, unknown or other
  modified_base (2472)..(2472): a, c, t, g, unknown or other
  modified_base (2475)..(2475): a, c, t, g, unknown or other
  modified_base (2507)..(2508): a, c, t, g, unknown or other
  modified_base (2524)..(2524): a, c, t, g, unknown or other
  modified_base (2529)..(2529): a, c, t, g, unknown or other
  modified_base (2544)..(2544): a, c, t, g, unknown or other
  modified_base (2559)..(2559): a, c, t, g, unknown or other
  modified_base (2589)..(2589): a, c, t, g, unknown or other
  modified_base (2619)..(2619): a, c, t, g, unknown or other
  modified_base (2625)..(2625): a, c, t, g, unknown or other
  modified_base (2628)..(2628): a, c, t, g, unknown or other
  modified_base (2641)..(2641): a, c, t, g, unknown or other
  modified_base (2682)..(2682): a, c, t, g, unknown or other
  modified_base (2694)..(2694): a, c, t, g, unknown or other
  modified_base (2713)..(2713): a, c, t, g, unknown or other
  modified_base (2727)..(2727): a, c, t, g, unknown or other
  modified_base (2730)..(2730): a, c, t, g, unknown or other
  modified_base (2736)..(2736): a, c, t, g, unknown or other
  modified_base (2742)..(2742): a, c, t, g, unknown or other
  modified_base (2749)..(2749): a, c, t, g, unknown or other
  modified_base (2781)..(2781): a, c, t, g, unknown or other
  modified_base (2787)..(2787): a, c, t, g, unknown or other
  modified_base (2796)..(2796): a, c, t, g, unknown or other
  modified_base (2799)..(2799): a, c, t, g, unknown or other
  modified_base (2808)..(2808): a, c, t, g, unknown or other
  modified_base (2823)..(2823): a, c, t, g, unknown or other
  modified_base (2830)..(2831): a, c, t, g, unknown or other
  modified_base (2835)..(2835): a, c, t, g, unknown or other
  modified_base (2838)..(2838): a, c, t, g, unknown or other
  modified_base (2840)..(2840): a, c, t, g, unknown or other
  modified_base (2931)..(2931): a, c, t, g, unknown or other
  modified_base (2957)..(2957): a, c, t, g, unknown or other
  modified_base (2961)..(2961): a, c, t, g, unknown or other
  modified_base (2966)..(2966): a, c, t, g, unknown or other
  modified_base (2974)..(2974): a, c, t, g, unknown or other
  modified_base (2976)..(2976): a, c, t, g, unknown or other
  modified_base (2979)..(2979): a, c, t, g, unknown or other
  modified_base (3028)..(3028): a, c, t, g, unknown or other
  modified_base (3073)..(3073): a, c, t, g, unknown or other
  modified_base (3102)..(3102): a, c, t, g, unknown or other
  modified_base (3123)..(3123): a, c, t, g, unknown or other
  modified_base (3132)..(3132): a, c, t, g, unknown or other
  modified_base (3150)..(3150): a, c, t, g, unknown or other
  modified_base (3156)..(3156): a, c, t, g, unknown or other
  modified_base (3189)..(3189): a, c, t, g, unknown or other
  modified_base (3195)..(3195): a, c, t, g, unknown or other
  modified_base (3209)..(3209): a, c, t, g, unknown or other
  modified_base (3225)..(3225): a, c, t, g, unknown or other
  modified_base (3249)..(3249): a, c, t, g, unknown or other
  modified_base (3287)..(3287): a, c, t, g, unknown or other
  modified_base (3332)..(3333): a, c, t, g, unknown or other
  modified_base (3336)..(3336): a, c, t, g, unknown or other
  modified_base (3368)..(3369): a, c, t, g, unknown or other
  modified_base (3384)..(3384): a, c, t, g, unknown or other
  modified_base (3394)..(3394): a, c, t, g, unknown or other
  modified_base (3402)..(3402): a, c, t, g, unknown or other
  modified_base (3408)..(3408): a, c, t, g, unknown or other
  modified_base (3449)..(3449): a, c, t, g, unknown or other
  modified_base (3504)..(3504): a, c, t, g, unknown or other
  modified_base (3540)..(3540): a, c, t, g, unknown or other
  modified_base (3561)..(3561): a, c, t, g, unknown or other
  modified_base (3564)..(3564): a, c, t, g, unknown or other
  modified_base (3591)..(3591): a, c, t, g, unknown or other
  modified_base (3602)..(3602): a, c, t, g, unknown or other
  modified_base (3619)..(3619): a, c, t, g, unknown or other
  modified_base (3637)..(3637): a, c, t, g, unknown or other
  modified_base (3645)..(3645): a, c, t, g, unknown or other
  modified_base (3681)..(3681): a, c, t, g, unknown or other
  modified_base (3693)..(3693): a, c, t, g, unknown or other
  modified_base (3727)..(3728): a, c, t, g, unknown or other
  modified_base (3744)..(3744): a, c, t, g, unknown or other
  modified_base (3747)..(3747): a, c, t, g, unknown or other
  modified_base (3756)..(3756): a, c, t, g, unknown or other
  modified_base (3765)..(3765): a, c, t, g, unknown or other
  modified_base (3833)..(3833): a, c, t, g, unknown or other
  modified_base (3851)..(3852): a, c, t, g, unknown or other
  modified_base (3855)..(3855): a, c, t, g, unknown or other
  modified_base (3913)..(3914): a, c, t, g, unknown or other
  modified_base (3930)..(3930): a, c, t, g, unknown or other
  modified_base (3972)..(3972): a, c, t, g, unknown or other
  modified_base (3999)..(3999): a, c, t, g, unknown or other
  modified_base (4003)..(4003): a, c, t, g, unknown or other
  modified_base (4005)..(4005): a, c, t, g, unknown or other
  modified_base (4008)..(4008): a, c, t, g, unknown or other
  modified_base (4017)..(4017): a, c, t, g, unknown or other
  modified_base (4021)..(4021): a, c, t, g, unknown or other
  modified_base (4039)..(4040): a, c, t, g, unknown or other
  modified_base (4044)..(4044): a, c, t, g, unknown or other
  modified_base (4059)..(4059): a, c, t, g, unknown or other
  modified_base (4104)..(4104): a, c, t, g, unknown or other
  modified_base (4131)..(4131): a, c, t, g, unknown or other
  modified_base (4137)..(4137): a, c, t, g, unknown or other
  modified_base (4143)..(4143): a, c, t, g, unknown or other
  modified_base (4152)..(4152): a, c, t, g, unknown or other
  modified_base (4206)..(4206): a, c, t, g, unknown or other
  modified_base (4219)..(4219): a, c, t, g, unknown or other
  modified_base (4221)..(4221): a, c, t, g, unknown or other
  modified_base (4233)..(4233): a, c, t, g, unknown or other
  modified_base (4239)..(4239): a, c, t, g, unknown or other
  modified_base (4247)..(4248): a, c, t, g, unknown or other
  modified_base (4251)..(4251): a, c, t, g, unknown or other
  modified_base (4257)..(4257): a, c, t, g, unknown or other
  modified_base (4264)..(4264): a, c, t, g, unknown or other
  modified_base (4266)..(4266): a, c, t, g, unknown or other
  modified_base (4272)..(4272): a, c, t, g, unknown or other
  modified_base (4281)..(4281): a, c, t, g, unknown or other
  modified_base (4302)..(4302): a, c, t, g, unknown or other
  modified_base (4304)..(4304): a, c, t, g, unknown or other
  modified_base (4311)..(4311): a, c, t, g, unknown or other
  modified_base (4324)..(4324): a, c, t, g, unknown or other
  modified_base (4332)..(4332): a, c, t, g, unknown or other
  modified_base (4341)..(4342): a, c, t, g, unknown or other
  modified_base (4353)..(4353): a, c, t, g, unknown or other
  modified_base (4369)..(4369): a, c, t, g, unknown or other
  modified_base (4396)..(4396): a, c, t, g, unknown or other
  modified_base (4419)..(4419): a, c, t, g, unknown or other
  modified_base (4433)..(4433): a, c, t, g, unknown or other
  modified_base (4437)..(4437): a, c, t, g, unknown or other
  modified_base (4458)..(4458): a, c, t, g, unknown or other
  modified_base (4460)..(4461): a, c, t, g, unknown or other
  modified_base (4468)..(4468): a, c, t, g, unknown or other
  modified_base (4477)..(4479): a, c, t, g, unknown or other
  modified_base (4486)..(4486): a, c, t, g, unknown or other
  modified_base (4497)..(4497): a, c, t, g, unknown or other
  modified_base (4522)..(4522): a, c, t, g, unknown or other
  modified_base (4545)..(4545): a, c, t, g, unknown or other
  modified_base (4549)..(4549): a, c, t, g, unknown or other
  modified_base (4558)..(4558): a, c, t, g, unknown or other
  modified_base (4566)..(4566): a, c, t, g, unknown or other
  modified_base (4576)..(4577): a, c, t, g, unknown or other
  modified_base (4597)..(5277): a, c, t, g, unknown or other
nnnnnnnnnnnnnnnnnnnnnnnnnnnnnnnnnnnnnnngcagtgctctttttggccggcctgaaccgagtggacacgcaaaccacttgcagggactgcacacagcgaggatgnntnnntgctgganaaccaggcnntcccggcttcccnggaatgcccggaccgccaggccatcctggaatgcccggantncccggactacacggcatncctggcnagccaggcgaacccggactnccgggcncacccggactgcctggagcgccnggnnatccnggcntncctggcnttcctggaatgccaggcacacanggcgtcccgggcctgccaggattgcctggatcaccgggacngcccggancgccnggcgnacccggcnatccaggcactcccggcttgcctggcaatccaggcacgcctggattgcctgganggccnggaccncccggantgcctgganngnnaggcganccnggactcggccttccggganngccnggnaanccaggaccacccggantgccgggaatgccaggaantcctggccctcccggcncnnncggntttccgggaattcccggcantccnggcnatccnggcattccaggactgccaggcncgccaggaatgccnggacanccgggcnttcccggaatnggcannccaggacngccngganngccgggcaanccnggagtgccaggactgccnggacntcccggactgccgggaattccaggagtaccngganttcccggaatgccaggnaanccgggcnagccaggacttcccggattgccgggcntgccnggcgnaccnggntttccnggaattccnggcatgcccggccatccnggaactccgggattgccaggcnntcctggnangccaggccngcccggantgccaggaatgccaggacngccgggcattccgggaatgccnggcctgccgggaannccnggacttccgggattnccgggnatgcccggaatgccnggcaaaccaggccngcccggattgccgggaatgccaggccctccaggnacgccaggcntcccnggantgccggggggtccnccaggcaagccaggaattccaggnctnccaggcattccaggaattcccggcnatcctggcgtncccggctcgcccggctttccaggaacncccggaacgccgggagagccaggcattcctggagtgccaggcatgccgggaattccgggaattccgggattgccnggctctccgggcgagccgggcaagcccggaatgccgggagtncctggcnttccaggngcgcccggaattccggganttcctggcccgcccggacaaccnggnctgccnggcgtgcccggcccaggcntgccnggaattccaggctagccgggagngcccggnatncctggattgcctggngngccgggcaatccgggatttccgggattgcctggantgcccggaccnggattgcctggaatgccaggaccgccaggacnaccaggactgccnggcattccnggcaatccaggccgtcccggagttcccggcatncctggancgccaggcattccngganancccggcgcncccggctagccaggagntcccggaatnccaggaatgccaggctngcccggacctcccggcgtgcctggacttccaggcannccaggcatgccnggaattccagganntcccggccagccgggcnttccngganttcccggnnctccgggattgccnggcacgcctggaattccgggcaagcccggaatgcctggattgcctggcaatccgggaatnccgggaggngtncccggtngtccgggcatgcccggaattcccggaatgccaggcatgccnggcagtcccggaantccaggagtgccaggaatgccaggacctcctggacttcccggcccgcccggcatgccaggaatnccnggcaatccaggcgntcccggaatgcctggcattccaggcacgccnggacngcccggaattcctggacttccgggcaatccgggcaaacctggtcttggcnatccgggcattccgggaatgcctggcgcgccaggctatccgggatntccgggcttgccgggaacgcctggantgccgggaatnccnggcacaccgggacccgccggacccggcggtccaggagtgcccggcnaaccaggnatgccaggatttcccggcangcccggcnntcccggcgtgccaggaacgcccggcaatccaggnaatcctggcattcccggcattccaggcattccaggcaatcctggattnccgggatcgccaggcnttccgggaccgccaggcattccnggnangccgggaatnccagganagccaggnattccnggatngccnggancgcctggcgatcctggcnttcccgganttcccggaatgcccggaattcctggcanaccaggcccgggaattccgggnatnccnggcgctccgggatttccaggattgcccggcanncccggcattcctggantgccnggaatgccaggcatnccaggcaatccgggnatgccgggaccgcccggaatgccaggaatnccaggcattccaggaattcccggaatgccnggcaanccnggccttccagganatcccggccttccaggcattcccggcatgcctggctcgccnggaatgcctggnacgcccggatttcccggantgcctggcaagccnggnattccnggaatnccggganttcccggacttcctggaacgcctggcgacccnggcttnccgggaacnccnggacttccnggattgcctggcatnccaggcnntccnggnantccgggcgcacccggctttcccggaattccaggaacgccaggcaatccaggaatacccggatttccgggcattccaggcacgccaggacanccgggcattcccggaatgccaggagntccnggccngccaggcnanccnggaatgccgggaagtccgggcaatcccggcttgccaggaatgcctggcntgccgggcaatccgggaatgcctggaatgccgggagagccgggcnaaccaggacttccgggtttgcctggaatnccgggaagtccaggacttccnggaatgccnggcatgcccggacctccnggcacnccaggatttcccggactgccaggaattccaggngagccnggaattcctggacngggaatgccgggaatncccggcccgccaggatttccgggngttcccggcaatccaggatatccaggaactcccggaangcctggaattccaggaattcccggctcgcctggcatgccaggaannccnggcattccgggaaatccaggaattccgggcannccaggcattccaggngtgcccggcnttccaggnaagccnggcactcccggaatgcctggctggccaggcattccaggcantcctggcttgcccggattgccgggaattcccggcaatcctggactgccgggactncccggaatgccaggcaaaccaggcattcccggaaancccggcactcctggatcgccnggnattcctggattgcccggcattcccggnaatccaggcgntccaggctttccgggantgccgggctttcccggcnttccaggnggtccaggaaatcccggcaagcccggaattcccggnttgccgggaatnccgggagcgcccggctatccaggaatgcctggcnngcccggacttcctggnatnccaggaganccgggaatnccgggaatgcccggaatgcctggaccgcctggacaaggtcttccaggcccacctggaatgccaggaantccgggagatcccggccnnccnggatttcccggaatgccaggaactcccggagagccaggcatgcccggcattcccgganngccaggactgccaggngatcccggcttgccgggaatgccaggcattccaggctcgccnggacctcccggaattcccggacgtccnggcntnccnggactgccnggantgcctggcaatcctggcnntccnggagtgccaggagtncccggcgagcctggcgctccaggattgccgggacctcctggaatnccgggccttcctggcattccaggagtncccggnatgccnggcgtgccnggcctgccaggagagccaggatttcccggcctgccaggaatgcccggacagccnggagtgccaggananccgggatttccnggattncctggcgnnccnggactncctggcntncccggnccacctggnccgccgggaccggcaggcccncntggaccnggcggtcccgganatcccggncttcccggnntgccaggcatnccgggcaatcctggcnatcccggattgcccggagtgcctgganctcctggaaatccgggagtgccnggatcgccaggaantccnggcaggcctggatatcccggncnnccagganttccgggcnnnccagganatccaggattncccggcatgcccggcactcccggcnatccaggacgtccgggagcgccnggcntgcctgganttcctggnctgcccgganngcccggcaaagatggattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 301 - DNA, 1596 bp, Artificial Sequence
  Description of Artificial Sequence: Synthetic polynucleotide
  modified_base (1)..(123): a, c, t, g, unknown or other
  modified_base (576)..(576): a, c, t, g, unknown or other
  modified_base (639)..(639): a, c, t, g, unknown or other
  modified_base (796)..(796): a, c, t, g, unknown or other
  modified_base (815)..(815): a, c, t, g, unknown or other
  modified_base (834)..(834): a, c, t, g, unknown or other
  modified_base (837)..(837): a, c, t, g, unknown or other
  modified_base (1132)..(1185): a, c, t, g, unknown or other
  modified_base (1356)..(1356): a, c, t, g, unknown or other
  modified_base (1506)..(1506): a, c, t, g, unknown or other
  modified_base (1594)..(1596): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcttctgttgaggatgtgtcttctgggaattacggatcctatggccttgttcaatcgacggagaaacgcgaaatccaatttgtggacattgggaaaattaatgcaagtctggacggtactcagatttggcttcgtggccggatccatgactcgcggggaaaaggcaaaaactgtttcatttgtattcgccagcggattcacagtgtccagggcgtgctctttgttgggccagagataagcaagcagttcgtaaagtttgcgcagaacatttccaaggagtccatcattgatgtgttcggcactgttgccaaaaccccatcgcctgtgtccagttgcacccaaagcgatgtggaaattcgcgtccaaaaattgtttgttgtgtccgcggcggagcctcgcttgccgttgcaaattgacgatgccagccgaccggagaacaaccaggacgancggagaacaaccaggacgaggggcttggcggttgtcaagctggacactcgacttgacaatcgngtgctcgaccttcgcaccccaaccagtcaggccattttccgccttcaggcagccgtttgtgctgctttccgctcatcattggccaagcggggtttcacggaaatccacacgcccaaaatcattccggctgccagtgaaggaggcgcaaatgtttttnaggtcagctatttcaaagnctccgcctacttggcccantcnccgcaactctacaagcaaatggcaatcgcgggcgactttgagcgcgtcttcaccattggcgccgtcttccgtgccgaagactcgaacacccatcgccacttgaccgaatttgtgggactcgacttggaaatggctttcaatttccactaccatgaggtactgtacacaattgctgaaatgctgttggaattgttcaagcatttgcaagccaatctccagcccgaaattcaagcagttggtcgacaatacccaagcgagcctttccttgtgcccgacaagccccttgttctacagnnnnnnnnnnnnnnnnnnnnnnnnnnnnnnnnnnnnnnnnnnnnnnnnnnnnnncaggatttgagcactccaaacgaaaagctgttgggccgccttgtccgagagcgttataagactgacttctacgtgctcgacaaatacccgctggtggtgcgtcccttctacacaatgcccgacccaaaggacgagcgctactccaacagctatgacatgttcatgcgagangaggagattctgtcgggcgctcagcgtgttcacgaccctgtgttgctcaccgaacgagccaaagtgcacaacgtggacatggacaagatcaagtcctacgtggatgccttcagatatggctgccctccgcacgctggcggtggaattganttggagcgtgtgactatgctctttctgggccttggcaatgtgcgcctttcttcgctgttcccgcgcgaccccaagcgcatcacccctnnn

SEQ ID NO: 302 - DNA, 546 bp, Artificial Sequence
  Description of Artificial Sequence: Synthetic polynucleotide
  modified_base (6)..(8): a, c, t, g, unknown or other
  modified_base (11)..(11): a, c, t, g, unknown or other
  modified_base (13)..(13): a, c, t, g, unknown or other
  modified_base (16)..(17): a, c, t, g, unknown or other
  modified_base (19)..(19): a, c, t, g, unknown or other
  modified_base (21)..(21): a, c, t, g, unknown or other
  modified_base (29)..(31): a, c, t, g, unknown or other
  modified_base (33)..(34): a, c, t, g, unknown or other
  modified_base (36)..(36): a, c, t, g, unknown or other
  modified_base (39)..(39): a, c, t, g, unknown or other
  modified_base (45)..(45): a, c, t, g, unknown or other
  modified_base (48)..(49): a, c, t, g, unknown or other
  modified_base (52)..(52): a, c, t, g, unknown or other
  modified_base (54)..(55): a, c, t, g, unknown or other
  modified_base (63)..(63): a, c, t, g, unknown or other
  modified_base (72)..(72): a, c, t, g, unknown or other
  modified_base (84)..(84): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (149)..(150): a, c, t, g, unknown or other
  modified_base (162)..(162): a, c, t, g, unknown or other
  modified_base (165)..(165): a, c, t, g, unknown or other
  modified_base (177)..(177): a, c, t, g, unknown or other
  modified_base (186)..(186): a, c, t, g, unknown or other
  modified_base (189)..(189): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (235)..(235): a, c, t, g, unknown or other
  modified_base (237)..(238): a, c, t, g, unknown or other
  modified_base (240)..(240): a, c, t, g, unknown or other
  modified_base (243)..(243): a, c, t, g, unknown or other
  modified_base (249)..(249): a, c, t, g, unknown or other
  modified_base (252)..(252): a, c, t, g, unknown or other
  modified_base (255)..(255): a, c, t, g, unknown or other
  modified_base (260)..(260): a, c, t, g, unknown or other
  modified_base (273)..(273): a, c, t, g, unknown or other
  modified_base (285)..(285): a, c, t, g, unknown or other
  modified_base (288)..(288): a, c, t, g, unknown or other
  modified_base (291)..(291): a, c, t, g, unknown or other
  modified_base (297)..(298): a, c, t, g, unknown or other
  modified_base (303)..(303): a, c, t, g, unknown or other
  modified_base (306)..(306): a, c, t, g, unknown or other
  modified_base (312)..(312): a, c, t, g, unknown or other
  modified_base (315)..(315): a, c, t, g, unknown or other
  modified_base (318)..(318): a, c, t, g, unknown or other
  modified_base (327)..(327): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (360)..(361): a, c, t, g, unknown or other
  modified_base (363)..(364): a, c, t, g, unknown or other
  modified_base (366)..(366): a, c, t, g, unknown or other
  modified_base (375)..(375): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (411)..(411): a, c, t, g, unknown or other
  modified_base (415)..(415): a, c, t, g, unknown or other
  modified_base (417)..(417): a, c, t, g, unknown or other
  modified_base (432)..(432): a, c, t, g, unknown or other
  modified_base (435)..(435): a, c, t, g, unknown or other
  modified_base (442)..(442): a, c, t, g, unknown or other
  modified_base (444)..(444): a, c, t, g, unknown or other
  modified_base (450)..(450): a, c, t, g, unknown or other
  modified_base (456)..(456): a, c, t, g, unknown or other
  modified_base (471)..(471): a, c, t, g, unknown or other
  modified_base (474)..(474): a, c, t, g, unknown or other
  modified_base (477)..(477): a, c, t, g, unknown or other
  modified_base (483)..(483): a, c, t, g, unknown or other
  modified_base (489)..(489): a, c, t, g, unknown or other
  modified_base (495)..(495): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
  modified_base (513)..(513): a, c, t, g, unknown or other
  modified_base (525)..(525): a, c, t, g, unknown or other
  modified_base (528)..(529): a, c, t, g, unknown or other
  modified_base (531)..(531): a, c, t, g, unknown or other
  modified_base (539)..(540): a, c, t, g, unknown or other
  modified_base (544)..(546): a, c, t, g, unknown or other
atgggnnntgnantcnncngnttgttcannngnntnttnggcaanaannaantnngaattctnatggtcggnttggatgctgcnggcaaaacnacnatnctntanaanctnaanctnggcganattgtnaccacnatnccaacnatagnnttcaatgtgganacngtcgagtacagnaacatctcnttnaccgtttgggatgtcggnggncangacaanattcgtccnctntggngnnantanttccanaanacncaagntctgatcttcgtngttgacagcaangancgngagcgnnttggngangcgcgnganganttgatgcgnatgcttgccganganganctncgngangctgtnntnntngtgtttgcnaacaaacanganttgccnaatgcnatgaangcngcngaantnacggacaaactgggnctncacacgntncgcaancgcaantggtacatccaagcnacntgngccacntctggngatggnctctacganggnctngantggctgagcaancanntnaagaaccnnagcnnn

SEQ ID NO: 303 - DNA, 501 bp, Artificial Sequence
  Description of Artificial Sequence: Synthetic polynucleotide
  modified_base (105)..(105): a, c, t, g, unknown or other
  modified_base (228)..(228): a, c, t, g, unknown or other
  modified_base (309)..(309): a, c, t, g, unknown or other
  modified_base (496)..(501): a, c, t, g, unknown or other
atggcaggaattgcagctggacgattggctgaagaacgcaaaggatggcgcaaggatcatccattcggattcatcgcacggccaacgaagaacgaagacggacgnaatttcaggttcaactgggagtgcgccatccccggcccgaaatcgaccatctgggagggcgggctgtacaagctgcgaatgatcttcaaggacgactttccgtcgacgccgccgaaatgcagnttcgagcctccgcttttccatccaaacgtctacccgtcgggcacggtttgtctcagtctgctggacgagaacaaggattgnaagccgtccatttcgatcaagcagctgctcgttggcatccaggaactgctcgtttcgccaaaccccgaggaccctgcccaggctgaggcgtaccagatctacgtgcaaaaccgtcctgagtacgagcggcgtgtccggaagcaggcgcagcaattcgcggaggacatggtgcagaagcaaatgcttnnnnnn

SEQ ID NO: 304 - DNA, 1665 bp, Artificial Sequence
  Description of Artificial Sequence: Synthetic polynucleotide
  modified_base (1)..(159): a, c, t, g, unknown or other
  modified_base (643)..(645): a, c, t, g, unknown or other
  modified_base (739)..(897): a, c, t, g, unknown or other
  modified_base (1107)..(1107): a, c, t, g, unknown or other
  modified_base (1393)..(1665): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagcgtgctggcatcaagaacacatgaatccgacatgcaagaattccttttcaatgcagaattggcaaatggaaaatttgaggccgagaaaagtgattttcgattggtaaatgcagagaacagttccatccaaattgagaaatttgaaatgagaagtttggaacaactgcacgctcaatatggagaacttctgcgaattcctcgtcgtccaaagattgggatttacaaagatgccgaagaattaaatgcgctggagtcaagtgaattcctggaatggcgaagaaacttggcaaaactcactgaagcaaacggactcatcatcaccccctttgaaagaaatctggaaatatggagacaattatggcgcgtcattgagcgaagtttaatagtagtacaggtcgtggatgcccgtaatcctcttttgtttagaagttccgatttggagaaatatgtaaaagaggttgatccaacaagggaaattnnnttgcttatcaacaaggcggatttacttactccagaacaaatccatttgtggaaatgttattttgatgagaagggaattgaatcaattttttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcattggcatggtcggctatccaaacgtgggaaagagttcaaccataaatcgtttgctgggtaccaaaaagacttctgtgtcggcaacgccgggcaaaacaaaacatttccaaacgcttcttatcgatgatcagatcaccctctgcgattgtccgggccttgtgatgccctcctttgggttgagcaacagtgagatgattttgaatgtnattttgccaatcgcccacatgcgcgactacttctcgccagtccaattgctctgcaatcgaatcccccgagagattctccagcaacgctactcaatcttattgcccaaacaaaattcaacgaatgcccatgatctgctcactgccgtcgctttcctcaaaggctttatgagcgctgcgggaattccggattgttctcgttccgcgcgactcattctcaatgactttgtccaaggcacactcaaatggtgtgccgcaccgcctgggatggagcaaaaagaattcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 305 - DNA, 1311 bp, Artificial Sequence
  Description of Artificial Sequence: Synthetic polynucleotide
  modified_base (1)..(6): a, c, t, g, unknown or other
  modified_base (129)..(129): a, c, t, g, unknown or other
  modified_base (156)..(156): a, c, t, g, unknown or other
  modified_base (246)..(246): a, c, t, g, unknown or other
  modified_base (249)..(249): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (333)..(333): a, c, t, g, unknown or other
  modified_base (335)..(335): a, c, t, g, unknown or other
  modified_base (339)..(340): a, c, t, g, unknown or other
  modified_base (342)..(344): a, c, t, g, unknown or other
  modified_base (346)..(349): a, c, t, g, unknown or other
  modified_base (351)..(352): a, c, t, g, unknown or other
  modified_base (354)..(354): a, c, t, g, unknown or other
  modified_base (730)..(738): a, c, t, g, unknown or other
  modified_base (829)..(834): a, c, t, g, unknown or other
  modified_base (1309)..(1311): a, c, t, g, unknown or other
nnnnnngtgaatgtcaaccgcaacgtgcaagatcccttctatcgctacaagatgccgcggattgtggccaaggtggagggcaagggcaacggcatcaagacggtcatcgcgaacatgcccgagattgcnaaggcgctgtcacgtcctccgacaacnccgaccaagtacttcggctgcgaactgggcgcccaaaccaacttcgacctgaagaacgaccgctacattgtcaacggggaacatgacgcnggnaagctgcanganttgttngacggcttcatcaagaagtttgtgctctgcccggcctgtgagaatccggaaactgttttgaccgtnangaannannngnnnnanncnaaatgcaaggcttgcggccacgcctatcagatcgatccgaagcagaagttgtccacgtacatcctgaagaacccgccggaaaatggggaagccgagaaggaggcgggcaaggagaatggcggcacgccaccaggcgaggaggccaccgacgagaatttgccggatccgctgaacagcacgggcaatggctccatggacaacgaggacgacgacgactgggcacccgagccggtgggagaggccgagaaactttctggagagatgagcaaaatggtcgtggacaaagatctggagaagtcggtggacgaacgcctggacatgctgcaccaattcttccagcgggccgtgcgcgacgggaccatccaggacagcaagnnnnnnnnncgcatgctgaacgaagccgaacgactggagctgaaaacgaaggcgccgctgctgctggccgacgtgctgttcacggaggagctggtggccnnnnnncaggtgaagcagaaccggaacctgctgctgcgcttctgcttgggcgacaagaaggcccaacgccacctgctgggcggcatcgagcagaaggtgcaggccaagaaggacgtcctcctgcccaagagtgcgcacatcatcaaggccctctacgacaacgacatttgcgaggaggaagtgatcctgggctgggcgggcaagccgagcggcaaatatgtgaagaaggacttcctgaaggagatgatcaaggtggcgcagccggtgatcaagtggctggaggaggcggaagaggactcggaggaggaggacgagggcgacatggccgttgcattcgacgatcgcagccgcgcggttacagtggtggaggaggaggagcaacagcagccggcaaagaaggttcaggccgaggcgggcaagaagggcggcgagcagcagaacaccaaggaggccgaggaggacttcgacattgacaacattnnn

SEQ ID NO: 306 - DNA, 579 bp, Artificial Sequence
  Description of Artificial Sequence: Synthetic polynucleotide
  modified_base (442)..(579): a, c, t, g, unknown or other
atgtcaactccatctcgtcgacgattgatgcgtgattttaagaaattacaggatgatccaccggctggtgtttctggtgctccaacagaggagtcaataatgcgatgggaagcagttatttttggtcccaatgacactccatttgaagacggcattttcaaattgagtttggaatttactgaagaatatccgaacaagccaccgactgtcaaatttgtctccaaaatgtttcatcctaatgtttatgccgatggaagcatttgtctggatattcttcagaatcaatggtcgcccacatatgatgttgccgccattctgacctcgattcaatcgctgctagacgaacccaacccaaacagccctgctaattccctggccgctcaactttaccaagaaaatcgtagagaatatgagaaacgcgtcaatgccatcgttgaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 307 - DNA, 639 bp, Artificial Sequence
  Description of Artificial Sequence: Synthetic polynucleotide
  modified_base (64)..(66): a, c, t, g, unknown or other
  modified_base (293)..(293): a, c, t, g, unknown or other
  modified_base (303)..(306): a, c, t, g, unknown or other
  modified_base (310)..(310): a, c, t, g, unknown or other
  modified_base (312)..(313): a, c, t, g, unknown or other
  modified_base (315)..(315): a, c, t, g, unknown or other
  modified_base (318)..(319): a, c, t, g, unknown or other
  modified_base (324)..(324): a, c, t, g, unknown or other
  modified_base (326)..(326): a, c, t, g, unknown or other
  modified_base (333)..(333): a, c, t, g, unknown or other
  modified_base (338)..(338): a, c, t, g, unknown or other
  modified_base (342)..(343): a, c, t, g, unknown or other
  modified_base (345)..(346): a, c, t, g, unknown or other
  modified_base (348)..(356): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (377)..(381): a, c, t, g, unknown or other
  modified_base (384)..(385): a, c, t, g, unknown or other
  modified_base (387)..(387): a, c, t, g, unknown or other
  modified_base (390)..(390): a, c, t, g, unknown or other
  modified_base (394)..(394): a, c, t, g, unknown or other
  modified_base (396)..(397): a, c, t, g, unknown or other
  modified_base (399)..(399): a, c, t, g, unknown or other
  modified_base (402)..(405): a, c, t, g, unknown or other
  modified_base (407)..(408): a, c, t, g, unknown or other
  modified_base (410)..(412): a, c, t, g, unknown or other
  modified_base (414)..(415): a, c, t, g, unknown or other
  modified_base (417)..(417): a, c, t, g, unknown or other
  modified_base (421)..(421): a, c, t, g, unknown or other
  modified_base (423)..(423): a, c, t, g, unknown or other
  modified_base (428)..(429): a, c, t, g, unknown or other
  modified_base (432)..(432): a, c, t, g, unknown or other
  modified_base (435)..(437): a, c, t, g, unknown or other
  modified_base (444)..(444): a, c, t, g, unknown or other
  modified_base (449)..(451): a, c, t, g, unknown or other
  modified_base (453)..(453): a, c, t, g, unknown or other
  modified_base (456)..(456): a, c, t, g, unknown or other
  modified_base (460)..(460): a, c, t, g, unknown or other
  modified_base (462)..(463): a, c, t, g, unknown or other
  modified_base (465)..(468): a, c, t, g, unknown or other
  modified_base (470)..(471): a, c, t, g, unknown or other
  modified_base (477)..(477): a, c, t, g, unknown or other
  modified_base (482)..(482): a, c, t, g, unknown or other
  modified_base (486)..(487): a, c, t, g, unknown or other
  modified_base (489)..(490): a, c, t, g, unknown or other
  modified_base (492)..(500): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (521)..(525): a, c, t, g, unknown or other
  modified_base (528)..(529): a, c, t, g, unknown or other
  modified_base (531)..(531): a, c, t, g, unknown or other
  modified_base (534)..(534): a, c, t, g, unknown or other
  modified_base (538)..(538): a, c, t, g, unknown or other
  modified_base (540)..(541): a, c, t, g, unknown or other
  modified_base (543)..(543): a, c, t, g, unknown or other
  modified_base (546)..(549): a, c, t, g, unknown or other
  modified_base (551)..(552): a, c, t, g, unknown or other
  modified_base (554)..(556): a, c, t, g, unknown or other
  modified_base (558)..(559): a, c, t, g, unknown or other
  modified_base (561)..(561): a, c, t, g, unknown or other
  modified_base (565)..(565): a, c, t, g, unknown or other
  modified_base (567)..(567): a, c, t, g, unknown or other
  modified_base (616)..(639): a, c, t, g, unknown or other
atgtcttccggcgttcaagtgaattccgagtgtcagactgcattccaacaactttcggaagcannnaagcgataccgctacatcatctacaagattgtggacaaggaagtcatggttgaggctgctgtgacggcagaagatattggctcgaacgaggacagttatgaggacaattcaaaggctgcatacgagacattcgtgaaggatctcaaggacaagactgacggattccaggactgccgctacgcggttttcgatttcaagttccaaacccatcgtccaggcgccggcanttccaaaatnnnnaaantnntnttnntccancnatgcccngatgnagcnncnntnnnnnnnnngatgctgtacgcntcntcngnnnnngcnntnaangccncnntnggnnnngnnannntnntncaantncaggnntcngannngtcgganattgnnnanaangaantnntnnnnanntgcccngatgnagcnncnntnnnnnnnnngatgctgtacgcntcntcngnnnnngcnntnaangccncnntnggnnnngnnannntnntncaantncaggcttctgagttgtcggacattgacgagaagacggtcaagcatgagnnnnnnnnnnnnnnnnnnnnnnnn

SEQ ID NO: 308 - DNA, 552 bp, Artificial Sequence
  Description of Artificial Sequence: Synthetic polynucleotide
  modified_base (154)..(162): a, c, t, g, unknown or other
  modified_base (348)..(361): a, c, t, g, unknown or other
  modified_base (363)..(365): a, c, t, g, unknown or other
  modified_base (369)..(369): a, c, t, g, unknown or other
  modified_base (541)..(552): a, c, t, g, unknown or other
atggtgcgcaagctgaagtaccacgagaagaagttgctgaagaaggtggacttcatccattgggaggtggacaacagtctgcacgagaaccaaataatgcgccgctaccacatcgagaagcgggaacattatacgctgtacaacaaactctcannnnnnnnncgcgagatggccaagcgcatccgggacctggaggacagcaaccccaacaagcccatcctggcccgtcggctgctcggcaaactgttcgacattgggctgatccccacggcggacacgctggagcgctgcgatcggatcaccgcctcctccttttgccggcgccgtttgcctgtggtcgtgcgcaannnnnnnnnnnnnncnnnggtncaaaaagccagccaaatggtggagcacgggcacatccgagtcggcgtggaaatgatcactgatccggccttcctcgttacccgcatccaatccgaccaagtcacctggactcggggctccaagatgaagaagcatgtgcacacctaccagaaccaacgggacgactttgagnnnnnnnnnnnn

SEQ ID NO: 309 - DNA, 1278 bp, Artificial Sequence
  Description of Artificial Sequence: Synthetic polynucleotide
  modified_base (1)..(366): a, c, t, g, unknown or other
  modified_base (478)..(489): a, c, t, g, unknown or other
  modified_base (544)..(588): a, c, t, g, unknown or other
  modified_base (703)..(786): a, c, t, g, unknown or other
  modified_base (955)..(978): a, c, t, g, unknown or other
  modified_base (1159)..(1161): a, c, t, g, unknown or other
  modified_base (1276)..(1278): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaatccaaagttggacaagaagcactacaacagctgaagacagcggttgacaccgccgaacgggttgccaagcaagtgggcgagacgcaggtgtacaagcaggttgccnnnnnnnnnnnntatgtggcccaagagattgacaagatcgccgatgtgaggatgtacacaaggccannnnnnnnnnnnnnnnnnnnnnnnnnnnnnnnnnnnnnnnnnnnnagaaaacccgaactttccagggacgccaccgacgtggagctgcacaaggagtcgcgctggtactccggctggaaatccttctccgagtcgaacccgtatttgaatagtgagttgnnnnnnnnnnnnnnnnnnnnnnnnnnnnnnnnnnnnnnnnnnnnnnnnnnnnnnnnnnnnnnnnnnnnnnnnnnnnnnnnnnnngcctcatcggattccacctccaatgtgctgaccgaaattgccaaggttgatcccgccttcaacgtgcatgagtggttgcggttctgcgagaaggaaatcatcccgaacatattggaggccggcatccagatgaatttggacgtgctgcaggattggtgctatgaacggnnnnnnnnnnnnnnnnnnnnnnnnctcaaggagtaccaaaaaattggcttccacaccaaggactcgcacatcattgatgttagcaaagttgagatgatcaatggcaagatgatcgacctgggcccagcactggccatcactttccaggtgttcatgctgcacgtggtgaagaacagcgagggcaaagtggtcgagggggatccgnnnaacccaatccgagtcaaccactactgggtgctgtgccgtgacatggagcagtacaacccggccaccgcttggaaactgctggagctgcacgtgcagaagggcaatttggtgatannn

SEQ ID NO: 310 - DNA, 1470 bp, Artificial Sequence
  Description of Artificial Sequence: Synthetic polynucleotide
  modified_base (1)..(147): a, c, t, g, unknown or other
  modified_base (273)..(273): a, c, t, g, unknown or other
  modified_base (298)..(300): a, c, t, g, unknown or other
  modified_base (432)..(432): a, c, t, g, unknown or other
  modified_base (504)..(504): a, c, t, g, unknown or other
  modified_base (664)..(666): a, c, t, g, unknown or other
  modified_base (963)..(963): a, c, t, g, unknown or other
  modified_base (966)..(967): a, c, t, g, unknown or other
  modified_base (975)..(975): a, c, t, g, unknown or other
  modified_base (1009)..(1009): a, c, t, g, unknown or other
  modified_base (1011)..(1011): a, c, t, g, unknown or other
  modified_base (1017)..(1017): a, c, t, g, unknown or other
  modified_base (1023)..(1023): a, c, t, g, unknown or other
  modified_base (1038)..(1038): a, c, t, g, unknown or other
  modified_base (1086)..(1086): a, c, t, g, unknown or other
  modified_base (1098)..(1098): a, c, t, g, unknown or other
  modified_base (1101)..(1101): a, c, t, g, unknown or other
  modified_base (1128)..(1128): a, c, t, g, unknown or other
  modified_base (1279)..(1470): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaataaacgaagagctgtgcaatgcctgcgaccggatcggctggagcaagccaatgccaatccaagagcaagtcatcccggcggcactcagtggacgtgatgttattggacttgccgagactggntccggaaaaaccggcgccttcgccnnncccatcctccaagcgctcatggactgtcagcaacggttgtttgccgtagtgttggcgccaaccagggagctggctttccaaatcacggaacagtttgaggcgcttggggccagcattgggctgcaagtttcnacaattgtgggcggcattgaaatgtccacccaaacgctgtccctctccaaaaggccgcacgtgattgtgganacccctggccgcctggtggaccatttggagaacacgaagggcttcgacctgcgcaccgtcaagtacctggtcatggacgaagccgaccgcatcctgaacatggactttgaggtggagttggacaaaatcctgaaagtcatcccgaagacgcgcaaaactnnnctcttctcggccacaatgacacaaaaggtttcgaagctggagagggcgcacttaaagaacccggcccgggtggaattgtcctcaaagtaccagacggtcagcacactcatccagaacatgctgttcattccgttcaaattccaggaagcctacctggtgtacgtgctgaacgagaaggccggcaacaccgccattgtgttctgcagcacatgcgccagtgcggtcaaaaccgcgttaatgctgcgccacttggggtttggcgcgattgcgttgcatgggcaaatgtcacagccaaancgnntgggcgcnctgaacaagttcaagaagaaggaccggtccattntngtttgnacggangtggcttcaagagtnctggacattccccacgtggacatggtggtgaactacgatgtgccggcncattccaaggantangtgcatcgggttgggcgaactgctcgngctgggaagtccggcattgcgctcaccatggtgacccaatacgatgtggaaatctaccaaaaagtggaggcttccatcgccaaacggcttgacccgatggaggtgaaccacgaggaggtgatgcaactggtcgagcgggtctccgaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 311 - DNA, 882 bp, Artificial Sequence
  Description of Artificial Sequence: Synthetic polynucleotide
  modified_base (415)..(417): a, c, t, g, unknown or other
  modified_base (624)..(624): a, c, t, g, unknown or other
  modified_base (880)..(882): a, c, t, g, unknown or other
atgggtttggtcaaagttgtcaagaaccgggcctacttcaagcgctaccagcccaagttcaagcgtcgtcgccagggcaagaccgactactatgcgcgcaaacggctgaccgttcaggacaagaacaagtacaacacgccaaagtatcggctgattgtgcgcttcaccaacaaggacatcattgcccagattgcctattcgcgcatccaaggcgacattgtggtgggagccgcttacgcgcatgaattgccacgctatggaattaagttgggcttgaccaactatgcggccgcctatgccaccggtttgctgttggctcgtcgccatctgcaaaagctcaagctggacacccactacaagggcaaagagaacgccgacggggagtacttcgacgtggagggcgacaaccccaatnnnccgttcacctgcgttctggacgttgggctggctcgaaccaccactggtgccaagatctttgccgtgatgaagggagttgctgatggtggcatccacattccgcacaggtgaaacgcgttcttcggctacgacaaggactccaagaactacgacccggccgcccatcgggaccgcatttttggcaaacatgtagcggactacatggancaattgaaagaggacgacgaggacgcttataagcgccaattctccaagttcatcaaggaggggattgcaccggaagcgctcgaaggaatctacaagaaggcacacgaggcaatccgcgccgacccgagcgcccagaagaaggagcccaagaagccggccaagcgcttcacacccaagaagttgacactgcgcgagcgcaaacaccgcgttgccaacaagaaggcctacctgatgcatctgaagaatgtgcaggagnnn

SEQ ID NO: 312 - DNA, 2502 bp, Artificial Sequence
  Description of Artificial Sequence: Synthetic polynucleotide
  modified_base (222)..(222): a, c, t, g, unknown or other
  modified_base (655)..(1851): a, c, t, g, unknown or other
  modified_base (1971)..(1971): a, c, t, g, unknown or other
  modified_base (2119)..(2121): a, c, t, g, unknown or other
  modified_base (2206)..(2208): a, c, t, g, unknown or other
  modified_base (2244)..(2244): a, c, t, g, unknown or other
  modified_base (2371)..(2502): a, c, t, g, unknown or other
atgggtaaaaaggcaaaaatcggaaaacaacgcaaggataaattttatttctggccaaggaggctggctaccgatcacgtgccgcgattcaaattgcttcaactgaacaaacgattcgaatttttgcaacaatcccgcgcacttgtggacttatgtgctgctcctggcggatggctgcaagtggccgagcagaacatgcccgtttcttcaattcgcatcgangtcgatcttgtgcccataaaaccaattaaaaattgcataactctccagggtgacatcaccgaagaaaagacacgtcatgcggtgcgcaaagagctgaacaaatgggaggcggactgtgttctgcacgacggcgccccaaacatcggcaccaactgggcccatgatgcttttgctcagaactgcttgaccctgtccgctctgcgcctggccacccagtgtttgcgccgaggcggttattttgtcaccaaagttttccgctcggccgactcccaactattggttggcgtttttgaaaagctgttcaaaaaggttcatgtctggaagccggctgcctcccgtctcgaatcggccgaaattttcatggtttgcgagaagttcttgaagccggacaagatggacccggaattgttggactcaaagaaagtgttctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaaggcaagtcggcacttcggaagcgcaaactcacacccgagcagctggccatgggcgagttgatgatccactcggggaagaaggcgcgcgaattggaggactgggcatggaattgntacgccagcaatgacgacggccttcccgagtggtttgtggcggacgagaagcggcactgtcgggaacaattgcccgtcgatcggagccgcattgcgcactacgcggaacgcgaccgacccctgaatgcgcgcacggtcaaaaaagttnnngaggcgaaaatgcgcaaaaagcagcggagaatgcggcggctggagaaggccaagaagaaggcggagggaattgtggacaacgagnnnatggagcacggggagaagatcagggagctgaagagnctttacaagaaggcagcaacaccggagaagaagaaggtcaaatatcaggtggtcaccaaaggcaagcgagggggaatgtcacggcccaagggcccctataaacttgtggaccgtcggttgaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 313 - DNA, 1956 bp, Artificial Sequence
  Description of Artificial Sequence: Synthetic polynucleotide
  modified_base (1)..(120): a, c, t, g, unknown or other
  modified_base (204)..(204): a, c, t, g, unknown or other
  modified_base (436)..(440): a, c, t, g, unknown or other
  modified_base (442)..(442): a, c, t, g, unknown or other
  modified_base (444)..(445): a, c, t, g, unknown or other
  modified_base (447)..(447): a, c, t, g, unknown or other
  modified_base (532)..(840): a, c, t, g, unknown or other
  modified_base (1057)..(1059): a, c, t, g, unknown or other
  modified_base (1326)..(1326): a, c, t, g, unknown or other
  modified_base (1441)..(1443): a, c, t, g, unknown or other
  modified_base (1489)..(1956): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccagtgggactgggccaaaaaatgcgcaccaaatcaacaataaatcggcttcggatgtacaagaacttcaagccaatcagngactcggccggcaaaatcgtgaaggccgcccctttccaagagcgcctaaagtcgggcacagtggcccgtgtggaaccccatcgaaaatggttcggcaacacccgggtggttggccaagagcagctgcagcgctttcaagaggaaataggcaaagttctgcacgaccccttccaagtggtgatgcgacagacgcgggcaccaatttcgttgctgcaggagaagggcaaagtannnnnantnnanattttggacacggaaagctttgagcacacatttggcaagaaggcacagcggaagcgagcgaatttgaaggccaccgatcttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagtggatgcaaatcctgtccaaggagttgcccaccatcgcattccacgccagcatccagcacagtttcggcaagggctccctgatcaacctgctccgccaattccacaaactccaccgcgaccggccccaaatcagcattggcctcattggctacccgaatgtgggcaagtcgtcggtggtgaacaccctccgggcgaagaaagtttgcaagnnngcgccgctggccggagagaccaagtattggcagtacgtgaccctgatgaagggcctctacctgattgactgtccgggagtggtctacccccatggggactccgagacggatttggtgctgaagggtgtggtccgagttgagaacgtcccggacccagaaaaccacattcaggctgtacttgaccgagtccgacccgagcatttggcacgtcacttcaacgtgcccaaggatgcggacgagaaggagaaattttggacagacgccgtngcctccggccgcctgctgaaaggcggagaacccgacctgaacacagtggcccgtcaaattctgaacgattaccagaggggcaacatcccgcattacgtgatcccgccgggctgtnnngaacgcgcaactcccacaccttctgaggcggccatggatgaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 314 - DNA, 3735 bp, Artificial Sequence
  Description of Artificial Sequence: Synthetic polynucleotide
  modified_base (229)..(339): a, c, t, g, unknown or other
  modified_base (601)..(3159): a, c, t, g, unknown or other
  modified_base (3273)..(3276): a, c, t, g, unknown or other
  modified_base (3278)..(3279): a, c, t, g, unknown or other
  modified_base (3288)..(3288): a, c, t, g, unknown or other
  modified_base (3327)..(3327): a, c, t, g, unknown or other
  modified_base (3340)..(3340): a, c, t, g, unknown or other
  modified_base (3351)..(3351): a, c, t, g, unknown or other
  modified_base (3354)..(3354): a, c, t, g, unknown or other
  modified_base (3363)..(3363): a, c, t, g, unknown or other
  modified_base (3399)..(3399): a, c, t, g, unknown or other
  modified_base (3438)..(3438): a, c, t, g, unknown or other
  modified_base (3443)..(3443): a, c, t, g, unknown or other
  modified_base (3556)..(3735): a, c, t, g, unknown or other
atgcgaatcaaacgaattgagatcgaaggattcaagtcatattccacacgcgaagtggtcgataatctcgaccctcaattcaatgcaattactggcctgaatggttcaggcaaatcaaatattctcgatgccatttgctttctgctcggcataacaaacctcgcaaatgtccgtgcccattcacttgcggatctcgtcttcaaacaaggtcaagccggcattaccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacttatcaaattaatggaactgcggcaacaaaccaacgcgtttccgacctcttccgaatggtcggcatgaatgtgaacaacccacatttcctcatcatgcaaggccgaatcaccaaagtgctgaacatgaaaccaatggaaattctctcgatgcttgaggaagcagccggtgtgagaatgtatgagtgcaagaaacaaagtgccattaaaaccattgagaaaaaggagtctaaagtggaggaaatttcacgggtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggatttctgtgcaatttattccacgcttttgcctggagccagtgccgaactcgttcctccctccggaacggaaaattgctcgggacttgaggttcgggttgcgttcaatggnnnntnnaaggactcnctggctgaactttcgggcggccaacgctcattggtggcnctttcactggtgntggcaatgctnaanttcaagccngcgcctttctacattctggatgagattgacgccgcnctggacatgtcacacaccgagaacatcgggaaaatgatnaaganccatttcggacagagccagtttatcgtcgtctctttgaagcaaggctttttcgacaatgcaaatgtggtctaccgagtccaattcaaagagggccgctcaatggtgacacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 315 - DNA, 3081 bp, Artificial Sequence
  Description of Artificial Sequence: Synthetic polynucleotide
  modified_base (1)..(276): a, c, t, g, unknown or other
  modified_base (346)..(348): a, c, t, g, unknown or other
  modified_base (474)..(474): a, c, t, g, unknown or other
  modified_base (741)..(741): a, c, t, g, unknown or other
  modified_base (841)..(951): a, c, t, g, unknown or other
  modified_base (1202)..(1202): a, c, t, g, unknown or other
  modified_base (1771)..(1938): a, c, t, g, unknown or other
  modified_base (2221)..(2394): a, c, t, g, unknown or other
  modified_base (2682)..(2682): a, c, t, g, unknown or other
  modified_base (2685)..(2685): a, c, t, g, unknown or other
  modified_base (2727)..(2727): a, c, t, g, unknown or other
  modified_base (2729)..(2731): a, c, t, g, unknown or other
  modified_base (2734)..(2734): a, c, t, g, unknown or other
  modified_base (2736)..(2736): a, c, t, g, unknown or other
  modified_base (2738)..(2740): a, c, t, g, unknown or other
  modified_base (2742)..(2742): a, c, t, g, unknown or other
  modified_base (2748)..(2754): a, c, t, g, unknown or other
  modified_base (2756)..(2758): a, c, t, g, unknown or other
  modified_base (2760)..(2760): a, c, t, g, unknown or other
  modified_base (2919)..(2919): a, c, t, g, unknown or other
  modified_base (2924)..(2924): a, c, t, g, unknown or other
  modified_base (2927)..(2928): a, c, t, g, unknown or other
  modified_base (2931)..(2931): a, c, t, g, unknown or other
  modified_base (3079)..(3081): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaactgcactcatgaggtctgccttccaatagatacggaatacaccccattggtgacgaaaacaggcnnngatcctgcaaagacatatcaattcaagcttgataaattccaaaaagcagcaatcaaatgtttggacaataaccaatctgtgttggtgtcggctcacacttccgctggcaaaaccgcagtcgcactntatgcaattgcattggctctccgagacaaccaaaaagtcatttatacatcaccaatcaaggcattgagcaaccagaaatacagggaattgtctgacgaatttgaggacgtcggcttggtgactggcgatgttacgctcaacccaaccgctgcttgtgtcgtgatgaccacagaaattctgcgttccatgctttaccgaggaaccgaagtaattcgggaagttggctgggtgatttttgacgaaattcactatatgcggacaaagggncgtggtgttgtttgggaggagacaatcatcttactgccagatatctgtcattatgttttcctttcggccacaatcccaaatgctaaggaatttgctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatttacagggcagtttcaaaaaagagaacttcaaaaaagcgatgggctttttgaccgaagctcagccagagggcgccaatgttcggagcagacgcagtggtggcggagaagctacgaataaaagcgttgtgaaaatcattcggacaattcaagagaaggaaatgctgccttgtatcatcttctccttcagccggaaagaatgtgaaatgcatgcctccaacatcaagcaaattgacttcaatacggnggaagaaaaggaggcaattaaaatgattttcggcaacgcagtcaaccttctctccgaagaagatcgcagacttccacaaatcaagggagtactcccatttcttctacgtggtattggtatccaccattccggccaattgccaatcatgaaagagattgtggaaatcctcttcggcgagggcctgatcaagacactttttgcaacagaaacatttgccatgggagtgaatatgcccgccaaaaccgtcctcttcacatctgctcgcaaatttgatgggaccaataatcggtggatcagcagcggggaatacatccaaatgagcgggcgagctggacgccgtggcaaagacgagaagggattggtcattttgatgttggacacccaaatgagtgaggaacaagccatacagctgattaagggaaatagcgatcccctgaactcgcaattccggcttacctacaatatggtgttgaacttactccgtgtgccagaaattaatcccgaatatatgttggagaaatcgtttcaccaatggcagaactacgcatcattgcccgcccttaaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacagcttcggcattacgacaaggactatgattggggcgttctcatcaattggcgcaaaactccaaaccctttgaacccaactgacatgctctacattgtggaagtggctgtccgcgtgtcgcccgagagtgagcgccatttgccaaacttgtcgatggttcgcccaccagatgagggcacgaatggagtgatcagcgttattccattcaccttcgactgcatcaccgccatcagcacaattcgactgaaaatcccgcaagaaatgaccaaccagggaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttcgaccaaatctacaaagcctatcagaataaggtgcaaattgaagaagactataaagcagcaaagaagcgctacgaagatgcaaagaagctgctgcaaaaggaagaattgcaaagtcgcaaacgtgtgctccaacgcctttgctattccactgagatgacacgattacggcaaaggggaagagttgcatgcgagttgagttcagccgatgagctgcttcttactgagatgatcttctccggcactttcaatgaaatggagccagaagaagcggctgctttgctnagntgctttgtctttgaagaacggacgcccagtggcaaactttcngnnnaantnannngntatctnnnnnnnannnanacaacagccaagcaaattgccaaaatctgcaatgagtgtcgacttgaggtggacgaggagaaatatgtggagaaattcggttctggcatgatggatgttgtgcacaattggtgcagaggcgccacattcgctcagattatggaaaatacgcaaatattngaagntanngtnatccggtgtatgcgccgattggatgagcttctgcaggaaatgacaaatgcagccaaggcactgaaggaaaccaaactggtggagaaatttgacaaggcacgggaattattgaaacgcgacattgtgttctcggcctccctctatttgnnn

SEQ ID NO: 316 - DNA, 1377 bp, Artificial Sequence
  Description of Artificial Sequence: Synthetic polynucleotide
  modified_base (1)..(93): a, c, t, g, unknown or other
  modified_base (420)..(420): a, c, t, g, unknown or other
  modified_base (876)..(876): a, c, t, g, unknown or other
  modified_base (1074)..(1074): a, c, t, g, unknown or other
  modified_base (1168)..(1377): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagttgctgcccacagccatgtgaaaggcctcggattggatgaggaaagtggccaagcgttggacaaagcacacggcttcattggacaatgcgaggcacgcgaagcggccggtgtcattgttgagttggtgcgccaaaagaaaatggcaggacgcgccgtgcttttggctgggcctcccgggactggcaagaccgcaattgcaatggcgatggcccaagagttgggcgacaaagtgccatttgtgccgctggtcgggtccgaagtgttctcgagtgaagtgaaaaagaccgaagtgctcatggagaacctgcggcgtgcaatcgtnctccgcgtcaaagagaagaaggaggttttcgagggcgaagtggtcgacttgacaccgatggagacggaaaacccaggcggctatgggaagacggtgtcgcatgtgctgtgcaccctgaaaaccacaaaaggctcgcgcgaacttcggcttgatcccagcatttacgactcgtttttgaagcaaaaagttgcggtcggggatgtcatctacattgaggccgggtctggcacagtcaagagaatgggacgctccgacattttcgccaacgaattcgacttggacgccgacgagtttgtgccaatgccgaaaggggatgtgcacaaaaccaaggagttacagcagtttgtcagcctccacgatttcgacgcagccaacgcaacgccgcatggcaaagcgggcgatgtaatgtccatgctgtcgcaaattttgaagccgaagaagacggaaattacaganaaactccgagccgaagtcaacaaagttgtgaaccagctgattgatgcgggacaagccgaactgctccccggcgtgctattcatcgacgaagtgcacatgctggacatggagtgcttcacattcctgcacagggcactcgagtccgaagtgaacccgatcattgtgttcgctacaaaccgagggcgcgtcaaaatcagnaattccgaagagcttgcattctacggaatcccgtcggacttgatcgaccgcctgctgatcgtgcccaccaagctgtactccccggaagaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 317 - DNA, 660 bp, Artificial Sequence
  Description of Artificial Sequence: Synthetic polynucleotide
  modified_base (1)..(27): a, c, t, g, unknown or other
  modified_base (57)..(57): a, c, t, g, unknown or other
  modified_base (115)..(116): a, c, t, g, unknown or other
  modified_base (180)..(180): a, c, t, g, unknown or other
  modified_base (604)..(660): a, c, t, g, unknown or other
nnnnnnnnnnnnnnnnnnnnnnnnnnnttttcagatgttgtcttcccaccaagtggnaaatataaattgccaccaatggcacccgagccaacctacaatgacttgttgggcgagnnaaagcacaaaatggacaaaaggatgattgatgcgcgtggttacgaggcgatacataccgagctnatccacaaacaatatgggcttgtggccatgttgggaggaaatattacggctgcggacttcacttggttacaggagcaaatcaacaacaagctgaaggaaaagcaattcgccatttggagggttgatgcgccgtggcttccacgcaccaagagacaacttggcgtgaagatgggcgccggtcgaggctcaatcaaccattatgtgacgccggttagggccggacgcattattgtggaaattggcggatatatcactgaggctgaggctcgtgcctatttgatgttcatccaccagcgtttcccttttcccgttgaattcatcagccaagagttgattgagaagagacgagaaatggaagccaaagtgaaggagatgaatgcgaacaagttcgattgggaaaccatgatcaagtacaatatgcagnnnnnnnnnnnnnnnnnnnnnnnnnnnnnnnnnnnnnnnnnnnnnnnnnnnnnnnnn

SEQ ID NO: 318 - DNA, 510 bp, Artificial Sequence
  Description of Artificial Sequence: Synthetic polynucleotide
  modified_base (1)..(33): a, c, t, g, unknown or other
  modified_base (147)..(147): a, c, t, g, unknown or other
  modified_base (210)..(210): a, c, t, g, unknown or other
  modified_base (463)..(510): a, c, t, g, unknown or other
nnnnnnnnnnnnnnnnnnnnnnnnnnnnnnnnngccctgatcgaagccgagcaagccatgtacggacccttcttcggctcgttgggcgtcaccgcggccatgatcttcacagcggccggctctgcttatggaacagcgaaatcagcnaccagcattgcttgcatgtccgtggccaggcccgatctcgtcatgaaagcaattattccagtngtgatggccggaattgtggcaatctacgggctggtggttgccgtcatcatttccggcaagctgacggtgggcgggcccgagtacaaggtggacgctggctacagccaattctgcgccggacttgtgtgtggcctgtgcggacttggggcgggctatgccatcgggattgtgggcgatgcgggcgtccgtgggttggcgcagcagccgcggctgtttgtgggcatgattttgatgctcatcttctcggaggttnnnnnnnnnnnnnnnnnnnnnnnnnnnnnnnnnnnnnnnnnnnnnnnn

SEQ ID NO: 319 - DNA, 11304 bp, Artificial Sequence
  Description of Artificial Sequence: Synthetic polynucleotide
  modified_base (1)..(1239): a, c, t, g, unknown or other
  modified_base (1248)..(1248): a, c, t, g, unknown or other
  modified_base (1257)..(1258): a, c, t, g, unknown or other
  modified_base (1266)..(1266): a, c, t, g, unknown or other
  modified_base (1271)..(1272): a, c, t, g, unknown or other
  modified_base (1293)..(1293): a, c, t, g, unknown or other
  modified_base (1296)..(1296): a, c, t, g, unknown or other
  modified_base (1299)..(1299): a, c, t, g, unknown or other
  modified_base (1334)..(1334): a, c, t, g, unknown or other
  modified_base (1353)..(1353): a, c, t, g, unknown or other
  modified_base (1359)..(1359): a, c, t, g, unknown or other
  modified_base (1362)..(1362): a, c, t, g, unknown or other
  modified_base (1368)..(1368): a, c, t, g, unknown or other
  modified_base (1370)..(1371): a, c, t, g, unknown or other
  modified_base (1379)..(1379): a, c, t, g, unknown or other
  modified_base (1403)..(1403): a, c, t, g, unknown or other
  modified_base (1420)..(1420): a, c, t, g, unknown or other
  modified_base (1422)..(1423): a, c, t, g, unknown or other
  modified_base (1425)..(1425): a, c, t, g, unknown or other
  modified_base (1428)..(1428): a, c, t, g, unknown or other
  modified_base (1434)..(1434): a, c, t, g, unknown or other
  modified_base (1446)..(1446): a, c, t, g, unknown or other
  modified_base (1460)..(1460): a, c, t, g, unknown or other
  modified_base (1465)..(1465): a, c, t, g, unknown or other
  modified_base (1468)..(1468): a, c, t, g, unknown or other
  modified_base (1494)..(1494): a, c, t, g, unknown or other
  modified_base (1512)..(1512): a, c, t, g, unknown or other
  modified_base (1526)..(1526): a, c, t, g, unknown or other
  modified_base (1531)..(1533): a, c, t, g, unknown or other
  modified_base (1550)..(1551): a, c, t, g, unknown or other
  modified_base (1555)..(1555): a, c, t, g, unknown or other
  modified_base (1557)..(1557): a, c, t, g, unknown or other
  modified_base (1577)..(1577): a, c, t, g, unknown or other
  modified_base (1582)..(1582): a, c, t, g, unknown or other
  modified_base (1609)..(1609): a, c, t, g, unknown or other
  modified_base (1611)..(1611): a, c, t, g, unknown or other
  modified_base (1618)..(1618): a, c, t, g, unknown or other
  modified_base (1653)..(1653): a, c, t, g, unknown or other
  modified_base (1673)..(1674): a, c, t, g, unknown or other
  modified_base (1689)..(1689): a, c, t, g, unknown or other
  modified_base (1696)..(1696): a, c, t, g, unknown or other
  modified_base (1699)..(1699): a, c, t, g, unknown or other
  modified_base (1702)..(1703): a, c, t, g, unknown or other
  modified_base (1801)..(1803): a, c, t, g, unknown or other
  modified_base (1838)..(1839): a, c, t, g, unknown or other
  modified_base (1841)..(1841): a, c, t, g, unknown or other
  modified_base (1851)..(1851): a, c, t, g, unknown or other
  modified_base (1855)..(1855): a, c, t, g, unknown or other
  modified_base (1862)..(1862): a, c, t, g, unknown or other
  modified_base (1897)..(1897): a, c, t, g, unknown or other
  modified_base (1910)..(1910): a, c, t, g, unknown or other
  modified_base (1914)..(1914): a, c, t, g, unknown or other
  modified_base (1943)..(1943): a, c, t, g, unknown or other
  modified_base (1957)..(1957): a, c, t, g, unknown or other
  modified_base (1960)..(1960): a, c, t, g, unknown or other
  modified_base (1981)..(1981): a, c, t, g, unknown or other
  modified_base (1998)..(1998): a, c, t, g, unknown or other
  modified_base (2004)..(2004): a, c, t, g, unknown or other
  modified_base (2012)..(2012): a, c, t, g, unknown or other
  modified_base (2017)..(2017): a, c, t, g, unknown or other
  modified_base (2022)..(2022): a, c, t, g, unknown or other
  modified_base (2112)..(2113): a, c, t, g, unknown or other
  modified_base (2120)..(2120): a, c, t, g, unknown or other
  modified_base (2131)..(2131): a, c, t, g, unknown or other
  modified_base (2157)..(2157): a, c, t, g, unknown or other
  modified_base (2177)..(2177): a, c, t, g, unknown or other
  modified_base (2193)..(2193): a, c, t, g, unknown or other
  modified_base (2196)..(2196): a, c, t, g, unknown or other
  modified_base (2198)..(2198): a, c, t, g, unknown or other
  modified_base (2216)..(2216): a, c, t, g, unknown or other
  modified_base (2235)..(2235): a, c, t, g, unknown or other
  modified_base (2252)..(2252): a, c, t, g, unknown or other
  modified_base (2273)..(2273): a, c, t, g, unknown or other
  modified_base (2284)..(2284): a, c, t, g, unknown or other
  modified_base (2286)..(2286): a, c, t, g, unknown or other
  modified_base (2307)..(2307): a, c, t, g, unknown or other
  modified_base (2323)..(2323): a, c, t, g, unknown or other
  modified_base (2325)..(2325): a, c, t, g, unknown or other
  modified_base (2338)..(2338): a, c, t, g, unknown or other
  modified_base (2355)..(2355): a, c, t, g, unknown or other
  modified_base (2421)..(2422): a, c, t, g, unknown or other
  modified_base (2424)..(2424): a, c, t, g, unknown or other
  modified_base (2428)..(2430): a, c, t, g, unknown or other
  modified_base (2502)..(2502): a, c, t, g, unknown or other
  modified_base (2504)..(2504): a, c, t, g, unknown or other
  modified_base (2521)..(2521): a, c, t, g, unknown or other
  modified_base (2526)..(2527): a, c, t, g, unknown or other
  modified_base (2532)..(2534): a, c, t, g, unknown or other
  modified_base (2539)..(2541): a, c, t, g, unknown or other
  modified_base (2549)..(2549): a, c, t, g, unknown or other
  modified_base (2551)..(2551): a, c, t, g, unknown or other
  modified_base (2558)..(2560): a, c, t, g, unknown or other
  modified_base (2562)..(2562): a, c, t, g, unknown or other
  modified_base (2574)..(2574): a, c, t, g, unknown or other
  modified_base (2581)..(2581): a, c, t, g, unknown or other
  modified_base (2597)..(2597): a, c, t, g, unknown or other
  modified_base (2601)..(2601): a, c, t, g, unknown or other
  modified_base (2624)..(2624): a, c, t, g, unknown or other
  modified_base (2647)..(2647): a, c, t, g, unknown or other
  modified_base (2694)..(2694): a, c, t, g, unknown or other
  modified_base (2763)..(2763): a, c, t, g, unknown or other
  modified_base (2777)..(2778): a, c, t, g, unknown or other
  modified_base (2854)..(2855): a, c, t, g, unknown or other
  modified_base (2907)..(2907): a, c, t, g, unknown or other
  modified_base (2937)..(2937): a, c, t, g, unknown or other
  modified_base (2950)..(2950): a, c, t, g, unknown or other
  modified_base (2953)..(2953): a, c, t, g, unknown or other
  modified_base (2958)..(2958): a, c, t, g, unknown or other
  modified_base (2987)..(2987): a, c, t, g, unknown or other
  modified_base (2989)..(2989): a, c, t, g, unknown or other
  modified_base (3011)..(3011): a, c, t, g, unknown or other
  modified_base (3029)..(3029): a, c, t, g, unknown or other
  modified_base (3034)..(3034): a, c, t, g, unknown or other
  modified_base (3037)..(3037): a, c, t, g, unknown or other
  modified_base (3039)..(3039): a, c, t, g, unknown or other
  modified_base (3041)..(3042): a, c, t, g, unknown or other
  modified_base (3048)..(3048): a, c, t, g, unknown or other
  modified_base (3052)..(3054): a, c, t, g, unknown or other
  modified_base (3061)..(3129): a, c, t, g, unknown or other
  modified_base (3172)..(3172): a, c, t, g, unknown or other
  modified_base (3174)..(3175): a, c, t, g, unknown or other
  modified_base (3178)..(3180): a, c, t, g, unknown or other
  modified_base (3182)..(3182): a, c, t, g, unknown or other
  modified_base (3184)..(3188): a, c, t, g, unknown or other
  modified_base (3190)..(3190): a, c, t, g, unknown or other
  modified_base (3195)..(3196): a, c, t, g, unknown or other
  modified_base (3199)..(3200): a, c, t, g, unknown or other
  modified_base (3202)..(3207): a, c, t, g, unknown or other
  modified_base (3209)..(3212): a, c, t, g, unknown or other
  modified_base (3214)..(3218): a, c, t, g, unknown or other
  modified_base (3220)..(3224): a, c, t, g, unknown or other
  modified_base (3230)..(3231): a, c, t, g, unknown or other
  modified_base (3237)..(3237): a, c, t, g, unknown or other
  modified_base (3247)..(3247): a, c, t, g, unknown or other
  modified_base (3285)..(3285): a, c, t, g, unknown or other
  modified_base (3307)..(3307): a, c, t, g, unknown or other
  modified_base (3324)..(3324): a, c, t, g, unknown or other
  modified_base (3327)..(3328): a, c, t, g, unknown or other
  modified_base (3334)..(3334): a, c, t, g, unknown or other
  modified_base (3336)..(3336): a, c, t, g, unknown or other
  modified_base (3346)..(3346): a, c, t, g, unknown or other
  modified_base (3360)..(3360): a, c, t, g, unknown or other
  modified_base (3406)..(3406): a, c, t, g, unknown or other
  modified_base (3457)..(3457): a, c, t, g, unknown or other
  modified_base (3469)..(3469): a, c, t, g, unknown or other
  modified_base (3472)..(3472): a, c, t, g, unknown or other
  modified_base (3484)..(3484): a, c, t, g, unknown or other
  modified_base (3496)..(3496): a, c, t, g, unknown or other
  modified_base (3513)..(3513): a, c, t, g, unknown or other
  modified_base (3576)..(3576): a, c, t, g, unknown or other
  modified_base (3588)..(3588): a, c, t, g, unknown or other
  modified_base (3598)..(3598): a, c, t, g, unknown or other
  modified_base (3627)..(3627): a, c, t, g, unknown or other
  modified_base (3634)..(3634): a, c, t, g, unknown or other
  modified_base (3637)..(3637): a, c, t, g, unknown or other
  modified_base (3655)..(3655): a, c, t, g, unknown or other
  modified_base (3658)..(3662): a, c, t, g, unknown or other
  modified_base (3664)..(3664): a, c, t, g, unknown or other
  modified_base (3668)..(3672): a, c, t, g, unknown or other
  modified_base (3676)..(3679): a, c, t, g, unknown or other
  modified_base (3682)..(3682): a, c, t, g, unknown or other
  modified_base (3684)..(3688): a, c, t, g, unknown or other
  modified_base (3690)..(3690): a, c, t, g, unknown or other
  modified_base (3927)..(3927): a, c, t, g, unknown or other
  modified_base (4047)..(4047): a, c, t, g, unknown or other
  modified_base (4164)..(4164): a, c, t, g, unknown or other
  modified_base (4276)..(4276): a, c, t, g, unknown or other
  modified_base (4281)..(4282): a, c, t, g, unknown or other
  modified_base (4284)..(4285): a, c, t, g, unknown or other
  modified_base (4287)..(4287): a, c, t, g, unknown or other
  modified_base (4293)..(4293): a, c, t, g, unknown or other
  modified_base (4296)..(4296): a, c, t, g, unknown or other
  modified_base (4303)..(4303): a, c, t, g, unknown or other
  modified_base (4305)..(4306): a, c, t, g, unknown or other
  modified_base (4309)..(4315): a, c, t, g, unknown or other
  modified_base (4318)..(4318): a, c, t, g, unknown or other
  modified_base (4323)..(4323): a, c, t, g, unknown or other
  modified_base (4325)..(4325): a, c, t, g, unknown or other
  modified_base (4328)..(4330): a, c, t, g, unknown or other
  modified_base (4332)..(4333): a, c, t, g, unknown or other
  modified_base (4335)..(4336): a, c, t, g, unknown or other
  modified_base (4338)..(4338): a, c, t, g, unknown or other
  modified_base (4340)..(4340): a, c, t, g, unknown or other
  modified_base (4342)..(4342): a, c, t, g, unknown or other
  modified_base (4344)..(4344): a, c, t, g, unknown or other
  modified_base (4347)..(4347): a, c, t, g, unknown or other
  modified_base (4350)..(4350): a, c, t, g, unknown or other
  modified_base (4352)..(4353): a, c, t, g, unknown or other
  modified_base (4359)..(4361): a, c, t, g, unknown or other
  modified_base (4364)..(4365): a, c, t, g, unknown or other
  modified_base (4371)..(4371): a, c, t, g, unknown or other
  modified_base (4373)..(4374): a, c, t, g, unknown or other
  modified_base (4382)..(4383): a, c, t, g, unknown or other
  modified_base (4386)..(4387): a, c, t, g, unknown or other
  modified_base (4389)..(4389): a, c, t, g, unknown or other
  modified_base (4392)..(4392): a, c, t, g, unknown or other
  modified_base (4404)..(4405): a, c, t, g, unknown or other
  modified_base (4407)..(4407): a, c, t, g, unknown or other
  modified_base (4416)..(4416): a, c, t, g, unknown or other
  modified_base (4419)..(4420): a, c, t, g, unknown or other
  modified_base (4423)..(4423): a, c, t, g, unknown or other
  modified_base (4428)..(4428): a, c, t, g, unknown or other
  modified_base (4431)..(4431): a, c, t, g, unknown or other
  modified_base (4437)..(4437): a, c, t, g, unknown or other
  modified_base (4443)..(4443): a, c, t, g, unknown or other
  modified_base (4534)..(4668): a, c, t, g, unknown or other
  modified_base (4756)..(4766): a, c, t, g, unknown or other
  modified_base (4770)..(4785): a, c, t, g, unknown or other
  modified_base (4787)..(4787): a, c, t, g, unknown or other
  modified_base (4791)..(4791): a, c, t, g, unknown or other
  modified_base (4794)..(4794): a, c, t, g, unknown or other
  modified_base (4797)..(4797): a, c, t, g, unknown or other
  modified_base (4810)..(4810): a, c, t, g, unknown or other
  modified_base (4813)..(4813): a, c, t, g, unknown or other
  modified_base (4825)..(4825): a, c, t, g, unknown or other
  modified_base (4841)..(4841): a, c, t, g, unknown or other
  modified_base (4845)..(4846): a, c, t, g, unknown or other
  modified_base (4878)..(4878): a, c, t, g, unknown or other
  modified_base (4929)..(4929): a, c, t, g, unknown or other
  modified_base (4944)..(4944): a, c, t, g, unknown or other
  modified_base (4949)..(4949): a, c, t, g, unknown or other
  modified_base (4971)..(4971): a, c, t, g, unknown or other
  modified_base (4995)..(4995): a, c, t, g, unknown or other
  modified_base (5021)..(5021): a, c, t, g, unknown or other
  modified_base (5040)..(5040): a, c, t, g, unknown or other
  modified_base (5059)..(5060): a, c, t, g, unknown or other
  modified_base (5093)..(5093): a, c, t, g, unknown or other
  modified_base (5097)..(5097): a, c, t, g, unknown or other
  modified_base (5116)..(5116): a, c, t, g, unknown or other
  modified_base (5119)..(5119): a, c, t, g, unknown or other
  modified_base (5136)..(5136): a, c, t, g, unknown or other
  modified_base (5155)..(5155): a, c, t, g, unknown or other
  modified_base (5166)..(5166): a, c, t, g, unknown or other
  modified_base (5172)..(5172): a, c, t, g, unknown or other
  modified_base (5187)..(5187): a, c, t, g, unknown or other
  modified_base (5230)..(5230): a, c, t, g, unknown or other
  modified_base (5236)..(5236): a, c, t, g, unknown or other
  modified_base (5247)..(5247): a, c, t, g, unknown or other
  modified_base (5258)..(5258): a, c, t, g, unknown or other
  modified_base (5269)..(5269): a, c, t, g, unknown or other
  modified_base (5274)..(5274): a, c, t, g, unknown or other
  modified_base (5286)..(5286): a, c, t, g, unknown or other
  modified_base (5288)..(5288): a, c, t, g, unknown or other
  modified_base (5307)..(5307): a, c, t, g, unknown or other
  modified_base (5311)..(5311): a, c, t, g, unknown or other
  modified_base (5313)..(5313): a, c, t, g, unknown or other
  modified_base (5315)..(5315): a, c, t, g, unknown or other
  modified_base (5330)..(5330): a, c, t, g, unknown or other
  modified_base (5365)..(5365): a, c, t, g, unknown or other
  modified_base (5377)..(5377): a, c, t, g, unknown or other
  modified_base (5395)..(5395): a, c, t, g, unknown or other
  modified_base (5397)..(5397): a, c, t, g, unknown or other
  modified_base (5423)..(5423): a, c, t, g, unknown or other
  modified_base (5430)..(5430): a, c, t, g, unknown or other
  modified_base (5443)..(5443): a, c, t, g, unknown or other
  modified_base (5497)..(5497): a, c, t, g, unknown or other
  modified_base (5551)..(5552): a, c, t, g, unknown or other
  modified_base (5574)..(5574): a, c, t, g, unknown or other
  modified_base (5601)..(5601): a, c, t, g, unknown or other
  modified_base (5649)..(5649): a, c, t, g, unknown or other
  modified_base (5698)..(5698): a, c, t, g, unknown or other
  modified_base (5735)..(5735): a, c, t, g, unknown or other
  modified_base (5739)..(5739): a, c, t, g, unknown or other
  modified_base (5754)..(5754): a, c, t, g, unknown or other
  modified_base (5756)..(5756): a, c, t, g, unknown or other
  modified_base (5760)..(5760): a, c, t, g, unknown or other
  modified_base (5776)..(5776): a, c, t, g, unknown or other
  modified_base (5784)..(5784): a, c, t, g, unknown or other
  modified_base (5836)..(5836): a, c, t, g, unknown or other
  modified_base (5859)..(5859): a, c, t, g, unknown or other
  modified_base (5876)..(5876): a, c, t, g, unknown or other
  modified_base (5895)..(5895): a, c, t, g, unknown or other
  modified_base (5904)..(5904): a, c, t, g, unknown or other
  modified_base (5927)..(5927): a, c, t, g, unknown or other
  modified_base (5936)..(5936): a, c, t, g, unknown or other
  modified_base (5942)..(5942): a, c, t, g, unknown or other
  modified_base (5984)..(5984): a, c, t, g, unknown or other
  modified_base (6000)..(6000): a, c, t, g, unknown or other
  modified_base (6004)..(6004): a, c, t, g, unknown or other
  modified_base (6027)..(6027): a, c, t, g, unknown or other
  modified_base (6031)..(6031): a, c, t, g, unknown or other
  modified_base (6040)..(6040): a, c, t, g, unknown or other
  modified_base (6051)..(6051): a, c, t, g, unknown or other
  modified_base (6058)..(6058): a, c, t, g, unknown or other
  modified_base (6063)..(6063): a, c, t, g, unknown or other
  modified_base (6067)..(6067): a, c, t, g, unknown or other
  modified_base (6087)..(6087): a, c, t, g, unknown or other
  modified_base (6089)..(6089): a, c, t, g, unknown or other
  modified_base (6121)..(6121): a, c, t, g, unknown or other
  modified_base (6128)..(6128): a, c, t, g, unknown or other
  modified_base (6153)..(6153): a, c, t, g, unknown or other
  modified_base (6161)..(6161): a, c, t, g, unknown or other
  modified_base (6177)..(6177): a, c, t, g, unknown or other
  modified_base (6180)..(6180): a, c, t, g, unknown or other
  modified_base (6189)..(6189): a, c, t, g, unknown or other
  modified_base (6193)..(6193): a, c, t, g, unknown or other
  modified_base (6197)..(6197): a, c, t, g, unknown or other
  modified_base (6199)..(6200): a, c, t, g, unknown or other
  modified_base (6205)..(6205): a, c, t, g, unknown or other
  modified_base (6207)..(6208): a, c, t, g, unknown or other
  modified_base (6210)..(6216): a, c, t, g, unknown or other
  modified_base (6218)..(6218): a, c, t, g, unknown or other
  modified_base (6220)..(6222): a, c, t, g, unknown or other
  modified_base (6224)..(6226): a, c, t, g, unknown or other
  modified_base (6228)..(6229): a, c, t, g, unknown or other
  modified_base (6231)..(6231): a, c, t, g, unknown or other
  modified_base (6235)..(6241): a, c, t, g, unknown or other
  modified_base (6243)..(6247): a, c, t, g, unknown or other
  modified_base (6249)..(6252): a, c, t, g, unknown or other
  modified_base (6258)..(6258): a, c, t, g, unknown or other
  modified_base (6260)..(6262): a, c, t, g, unknown or other
  modified_base (6265)..(6277): a, c, t, g, unknown or other
  modified_base (6279)..(6282): a, c, t, g, unknown or other
  modified_base (6285)..(6286): a, c, t, g, unknown or other
  modified_base (6288)..(6288): a, c, t, g, unknown or other
  modified_base (6290)..(6290): a, c, t, g, unknown or other
  modified_base (6292)..(6292): a, c, t, g, unknown or other
  modified_base (6294)..(6297): a, c, t, g, unknown or other
  modified_base (6299)..(6299): a, c, t, g, unknown or other
  modified_base (6301)..(6303): a, c, t, g, unknown or other
  modified_base (6309)..(6309): a, c, t, g, unknown or other
  modified_base (6328)..(6328): a, c, t, g, unknown or other
  modified_base (6330)..(6330): a, c, t, g, unknown or other
  modified_base (6334)..(6334): a, c, t, g, unknown or other
  modified_base (6337)..(6337): a, c, t, g, unknown or other
  modified_base (6417)..(6417): a, c, t, g, unknown or other
  modified_base (6422)..(6422): a, c, t, g, unknown or other
  modified_base (6441)..(6441): a, c, t, g, unknown or other
  modified_base (6472)..(6472): a, c, t, g, unknown or other
  modified_base (6478)..(6480): a, c, t, g, unknown or other
  modified_base (6482)..(6482): a, c, t, g, unknown or other
  modified_base (6534)..(6534): a, c, t, g, unknown or other
  modified_base (6546)..(6546): a, c, t, g, unknown or other
  modified_base (6586)..(6586): a, c, t, g, unknown or other
  modified_base (6593)..(6593): a, c, t, g, unknown or other
  modified_base (6600)..(6600): a, c, t, g, unknown or other
  modified_base (6616)..(6616): a, c, t, g, unknown or other
  modified_base (6648)..(6648): a, c, t, g, unknown or other
  modified_base (6752)..(6752): a, c, t, g, unknown or other
  modified_base (6756)..(6756): a, c, t, g, unknown or other
  modified_base (6772)..(6772): a, c, t, g, unknown or other
  modified_base (6774)..(6774): a, c, t, g, unknown or other
  modified_base (6776)..(6776): a, c, t, g, unknown or other
  modified_base (6778)..(6778): a, c, t, g, unknown or other
  modified_base (6783)..(6783): a, c, t, g, unknown or other
  modified_base (6792)..(6792): a, c, t, g, unknown or other
  modified_base (6829)..(6829): a, c, t, g, unknown or other
  modified_base (6858)..(6858): a, c, t, g, unknown or other
  modified_base (6868)..(6868): a, c, t, g, unknown or other
  modified_base (6886)..(6886): a, c, t, g, unknown or other
  modified_base (6898)..(6898): a, c, t, g, unknown or other
  modified_base (6906)..(6906): a, c, t, g, unknown or other
  modified_base (6982)..(6982): a, c, t, g, unknown or other
  modified_base (6990)..(6990): a, c, t, g, unknown or other
  modified_base (6992)..(6992): a, c, t, g, unknown or other
  modified_base (6996)..(6996): a, c, t, g, unknown or other
  modified_base (7017)..(7017): a, c, t, g, unknown or other
  modified_base (7025)..(7025): a, c, t, g, unknown or other
  modified_base (7027)..(7027): a, c, t, g, unknown or other
  modified_base (7044)..(7044): a, c, t, g, unknown or other
  modified_base (7074)..(7074): a, c, t, g, unknown or other
  modified_base (7089)..(7089): a, c, t, g, unknown or other
  modified_base (7101)..(7101): a, c, t, g, unknown or other
  modified_base (7119)..(7119): a, c, t, g, unknown or other
  modified_base (7125)..(7125): a, c, t, g, unknown or other
  modified_base (7175)..(7176): a, c, t, g, unknown or other
  modified_base (7184)..(7185): a, c, t, g, unknown or other
  modified_base (7197)..(7197): a, c, t, g, unknown or other
  modified_base (7199)..(7199): a, c, t, g, unknown or other
  modified_base (7224)..(7224): a, c, t, g, unknown or other
  modified_base (7231)..(7231): a, c, t, g, unknown or other
  modified_base (7246)..(7247): a, c, t, g, unknown or other
  modified_base (7260)..(7261): a, c, t, g, unknown or other
  modified_base (7276)..(7276): a, c, t, g, unknown or other
  modified_base (7283)..(7283): a, c, t, g, unknown or other
  modified_base (7301)..(7301): a, c, t, g, unknown or other
  modified_base (7314)..(7314): a, c, t, g, unknown or other
  modified_base (7322)..(7322): a, c, t, g, unknown or other
  modified_base (7338)..(7338): a, c, t, g, unknown or other
  modified_base (7342)..(7342): a, c, t, g, unknown or other
  modified_base (7350)..(7350): a, c, t, g, unknown or other
  modified_base (7356)..(7356): a, c, t, g, unknown or other
  modified_base (7369)..(7369): a, c, t, g, unknown or other
  modified_base (7372)..(7372): a, c, t, g, unknown or other
  modified_base (7382)..(7382): a, c, t, g, unknown or other
  modified_base (7390)..(7390): a, c, t, g, unknown or other
  modified_base (7392)..(7392): a, c, t, g, unknown or other
  modified_base (7407)..(7409): a, c, t, g, unknown or other
  modified_base (7418)..(7418): a, c, t, g, unknown or other
  modified_base (7443)..(7443): a, c, t, g, unknown or other
  modified_base (7445)..(7445): a, c, t, g, unknown or other
  modified_base (7466)..(7466): a, c, t, g, unknown or other
  modified_base (7468)..(7468): a, c, t, g, unknown or other
  modified_base (7475)..(7475): a, c, t, g, unknown or other
  modified_base (7478)..(7478): a, c, t, g, unknown or other
  modified_base (7486)..(7487): a, c, t, g, unknown or other
  modified_base (7491)..(7492): a, c, t, g, unknown or other
  modified_base (7494)..(7494): a, c, t, g, unknown or other
  modified_base (7497)..(7497): a, c, t, g, unknown or other
  modified_base (7503)..(7503): a, c, t, g, unknown or other
  modified_base (7514)..(7514): a, c, t, g, unknown or other
  modified_base (7528)..(7529): a, c, t, g, unknown or other
  modified_base (7533)..(7533): a, c, t, g, unknown or other
  modified_base (7540)..(7540): a, c, t, g, unknown or other
  modified_base (7557)..(7559): a, c, t, g, unknown or other
  modified_base (7561)..(7562): a, c, t, g, unknown or other
  modified_base (7569)..(7569): a, c, t, g, unknown or other
  modified_base (7581)..(7584): a, c, t, g, unknown or other
  modified_base (7587)..(7587): a, c, t, g, unknown or other
  modified_base (7589)..(7589): a, c, t, g, unknown or other
  modified_base (7613)..(7613): a, c, t, g, unknown or other
  modified_base (7625)..(7625): a, c, t, g, unknown or other
  modified_base (7642)..(7642): a, c, t, g, unknown or other
  modified_base (7644)..(7644): a, c, t, g, unknown or other
  modified_base (7683)..(7683): a, c, t, g, unknown or other
  modified_base (7695)..(7695): a, c, t, g, unknown or other
  modified_base (7718)..(7718): a, c, t, g, unknown or other
  modified_base (7757)..(7757): a, c, t, g, unknown or other
  modified_base (7765)..(7765): a, c, t, g, unknown or other
  modified_base (7821)..(7821): a, c, t, g, unknown or other
  modified_base (7857)..(7857): a, c, t, g, unknown or other
  modified_base (7863)..(7863): a, c, t, g, unknown or other
  modified_base (7868)..(7868): a, c, t, g, unknown or other
  modified_base (7909)..(7909): a, c, t, g, unknown or other
  modified_base (7972)..(7972): a, c, t, g, unknown or other
  modified_base (7977)..(7977): a, c, t, g, unknown or other
  modified_base (7997)..(7997): a, c, t, g, unknown or other
  modified_base (8064)..(8064): a, c, t, g, unknown or other
  modified_base (8073)..(8073): a, c, t, g, unknown or other
  modified_base (8087)..(8087): a, c, t, g, unknown or other
  modified_base (8119)..(8119): a, c, t, g, unknown or other
  modified_base (8134)..(8134): a, c, t, g, unknown or other
  modified_base (8142)..(8142): a, c, t, g, unknown or other
  modified_base (8184)..(8184): a, c, t, g, unknown or other
  modified_base (8189)..(8189): a, c, t, g, unknown or other
  modified_base (8213)..(8213): a, c, t, g, unknown or other
  modified_base (8226)..(8226): a, c, t, g, unknown or other
  modified_base (8263)..(8263): a, c, t, g, unknown or other
  modified_base (8266)..(8266): a, c, t, g, unknown or other
  modified_base (8268)..(8268): a, c, t, g, unknown or other
  modified_base (8289)..(8289): a, c, t, g, unknown or other
  modified_base (8302)..(8302): a, c, t, g, unknown or other
  modified_base (8313)..(8313): a, c, t, g, unknown or other
  modified_base (8344)..(8344): a, c, t, g, unknown or other
  modified_base (8346)..(8346): a, c, t, g, unknown or other
  modified_base (8350)..(8350): a, c, t, g, unknown or other
  modified_base (8353)..(8354): a, c, t, g, unknown or other
  modified_base (8373)..(8373): a, c, t, g, unknown or other
  modified_base (8379)..(8379): a, c, t, g, unknown or other
  modified_base (8408)..(8409): a, c, t, g, unknown or other
  modified_base (8415)..(8415): a, c, t, g, unknown or other
  modified_base (8418)..(8418): a, c, t, g, unknown or other
  modified_base (8425)..(8425): a, c, t, g, unknown or other
  modified_base (8431)..(8431): a, c, t, g, unknown or other
  modified_base (8439)..(8439): a, c, t, g, unknown or other
  modified_base (8442)..(8443): a, c, t, g, unknown or other
  modified_base (8448)..(8676): a, c, t, g, unknown or other
  modified_base (8835)..(8835): a, c, t, g, unknown or other
  modified_base (8872)..(8874): a, c, t, g, unknown or other
  modified_base (9013)..(9051): a, c, t, g, unknown or other
  modified_base (9246)..(9246): a, c, t, g, unknown or other
  modified_base (9301)..(9301): a, c, t, g, unknown or other
  modified_base (9303)..(9304): a, c, t, g, unknown or other
  modified_base (9306)..(9308): a, c, t, g, unknown or other
  modified_base (9310)..(9310): a, c, t, g, unknown or other
  modified_base (9312)..(9312): a, c, t, g, unknown or other
  modified_base (9315)..(9315): a, c, t, g, unknown or other
  modified_base (9318)..(9319): a, c, t, g, unknown or other
  modified_base (9321)..(9322): a, c, t, g, unknown or other
  modified_base (9332)..(9333): a, c, t, g, unknown or other
  modified_base (9337)..(9337): a, c, t, g, unknown or other
  modified_base (9339)..(9339): a, c, t, g, unknown or other
  modified_base (9343)..(9343): a, c, t, g, unknown or other
  modified_base (9345)..(9345): a, c, t, g, unknown or other
  modified_base (9349)..(9352): a, c, t, g, unknown or other
  modified_base (9354)..(9354): a, c, t, g, unknown or other
  modified_base (9550)..(9550): a, c, t, g, unknown or other
  modified_base (9558)..(9558): a, c, t, g, unknown or other
  modified_base (9562)..(9562): a, c, t, g, unknown or other
  modified_base (9569)..(9569): a, c, t, g, unknown or other
  modified_base (9579)..(9579): a, c, t, g, unknown or other
  modified_base (9584)..(9584): a, c, t, g, unknown or other
  modified_base (9588)..(9588): a, c, t, g, unknown or other
  modified_base (9593)..(9594): a, c, t, g, unknown or other
  modified_base (9610)..(9610): a, c, t, g, unknown or other
  modified_base (9619)..(9619): a, c, t, g, unknown or other
  modified_base (9622)..(9622): a, c, t, g, unknown or other
  modified_base (9631)..(9632): a, c, t, g, unknown or other
  modified_base (9638)..(9638): a, c, t, g, unknown or other
  modified_base (9657)..(9657): a, c, t, g, unknown or other
  modified_base (9673)..(9674): a, c, t, g, unknown or other
  modified_base (9691)..(9691): a, c, t, g, unknown or other
  modified_base (9705)..(9705): a, c, t, g, unknown or other
  modified_base (9709)..(9710): a, c, t, g, unknown or other
  modified_base (9722)..(9722): a, c, t, g, unknown or other
  modified_base (9733)..(9733): a, c, t, g, unknown or other
  modified_base (9738)..(9739): a, c, t, g, unknown or other
  modified_base (9742)..(9744): a, c, t, g, unknown or other
  modified_base (9755)..(9755): a, c, t, g, unknown or other
  modified_base (9771)..(9771): a, c, t, g, unknown or other
  modified_base (9777)..(9778): a, c, t, g, unknown or other
  modified_base (9789)..(9789): a, c, t, g, unknown or other
  modified_base (9813)..(9813): a, c, t, g, unknown or other
  modified_base (9817)..(9817): a, c, t, g, unknown or other
  modified_base (9819)..(9819): a, c, t, g, unknown or other
  modified_base (9825)..(9825): a, c, t, g, unknown or other
  modified_base (9830)..(9831): a, c, t, g, unknown or other
  modified_base (9847)..(9847): a, c, t, g, unknown or other
  modified_base (9849)..(9849): a, c, t, g, unknown or other
  modified_base (9857)..(9857): a, c, t, g, unknown or other
  modified_base (9860)..(9860): a, c, t, g, unknown or other
  modified_base (9865)..(9865): a, c, t, g, unknown or other
  modified_base (9873)..(9873): a, c, t, g, unknown or other
  modified_base (9879)..(9879): a, c, t, g, unknown or other
  modified_base (9881)..(9881): a, c, t, g, unknown or other
  modified_base (9885)..(9885): a, c, t, g, unknown or other
  modified_base (9892)..(9893): a, c, t, g, unknown or other
  modified_base (9903)..(9906): a, c, t, g, unknown or other
  modified_base (9908)..(9908): a, c, t, g, unknown or other
  modified_base (9921)..(9929): a, c, t, g, unknown or other
  modified_base (9931)..(9932): a, c, t, g, unknown or other
  modified_base (9936)..(9937): a, c, t, g, unknown or other
  modified_base (9939)..(9939): a, c, t, g, unknown or other
  modified_base (9945)..(9945): a, c, t, g, unknown or other
  modified_base (9948)..(9949): a, c, t, g, unknown or other
  modified_base (9951)..(9952): a, c, t, g, unknown or other
  modified_base (9957)..(9957): a, c, t, g, unknown or other
  modified_base (9960)..(9960): a, c, t, g, unknown or other
  modified_base (9963)..(9963): a, c, t, g, unknown or other
  modified_base (9970)..(9970): a, c, t, g, unknown or other
  modified_base (9972)..(9975): a, c, t, g, unknown or other
  modified_base (9978)..(9978): a, c, t, g, unknown or other
  modified_base (9980)..(9980): a, c, t, g, unknown or other
  modified_base (10018)..(10018): a, c, t, g, unknown or other
  modified_base (10020)..(10021): a, c, t, g, unknown or other
  modified_base (10024)..(10024): a, c, t, g, unknown or other
  modified_base (10026)..(10026): a, c, t, g, unknown or other
  modified_base (10032)..(10032): a, c, t, g, unknown or other
  modified_base (10044)..(10044): a, c, t, g, unknown or other
  modified_base (10050)..(10050): a, c, t, g, unknown or other
  modified_base (10057)..(10057): a, c, t, g, unknown or other
  modified_base (10063)..(10065): a, c, t, g, unknown or other
  modified_base (10069)..(10069): a, c, t, g, unknown or other
  modified_base (10071)..(10074): a, c, t, g, unknown or other
  modified_base (10076)..(10077): a, c, t, g, unknown or other
  modified_base (10079)..(10083): a, c, t, g, unknown or other
  modified_base (10297)..(11304): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgcaancgcttggtnnacgaatgngcganngggcaacatgattgctacccnacngcnatttgcgtggataccgacgaaggctacacgtgccnttgccgggccggctacatngacatntcnccggantnnggcaaacngccgggccgaagatgcgttgaggncgtcaacgaatgcctgnanncnganctgaangactgctcgganaatgccatttgcanggacnccnccgaaggctacacttgccgttgccgncccggcttcttggacatntccccgaacatcancaaannnccgggccgaatctgcanngagntngtgaacgaatgcgcgaacgngctgnatgactgctcccaaaatgccaattgcnangacaccnaggagggctacacttgcaaatgccggcccggcttnttggatgtgtccccgaatgnngtgcaaccgggccgnaaatgcntgnaanncgtgaatgaatgcgccaacccggcactgaacaattgcagtaaatttcacgacaaggaggagggctactattgtgtttgccgccccggcttccgtgatnnngacaacccaagccagccgggcacacagtgcactgnnanggtgaacgantgcntgaaccnggatctgaacgattgcgacccaaatgccaattgcnttgataacgaggncggntacttcacgtgccgttgccgccccggctncgtcgacatctccncgnacaacaaacacccgggccganactgcgttgaggccgtnaacgantgcgcgcnggccnagaangactgctcggagaatgccctttgcaaggactcgccggagggctacacgtgccattgccggcccggcttcctggacgtgtccccggaccannagaacantccgggccgantctgcaagcaggtggacgaatgcgcnaagaacgattgcgacaaaantgcgaattgcatgganacngncgaaggctacacgtgccnttgccgtcccggcttcgtngacgtgtcgccggatcncgacaagcagccgggccgaangtgcgttgcgntngtgaacgaatgcctggatgcnaagaacgactgctcgnanaatgcggattgcnatgactccaaggagggnttcacgtgcaattgccggcccggcttcctggacgagtccgccaacactggcaaacagccgggccgnnantgcnnngagaagatcaacgagtgtaggccggatctgaacgattgtgacaaaattgccacttgcaaggatttgcccgangnctacacctgcatttgcncaccnnactcnnntgacnnntcgccggncnaaggccnnnanccgggtggtcgntgcctantcatcaatgagtgccngaanccggagctgaacgattgctaccnaaatgcggaatgcatggacatgnccgaaggctacacttgccgttgccgtcccggcttcgtcgacgactcnccggagaaccagccgggccgactttgcatagcgctggtgaacgaatgcgccaatgcggagcagaacaangttgactgctcccnnaatgcgaattgcgtggacaccgaggagggctacacgtgccgatgccggcccggcttcgtggacgtctcgccggacnncggcaaacagccgggccgaaagtgcgttgagttggtgaacgaatgcgcgaanccggagctgaacgattgctcccagaatgcnatttgcaaggacnccnagganggctacacgtgcaattgccggcccggctntntggacgtgtccccgaacacggncaagcagccgggccgaangtgcncanangnngtggangatnnnaaaaccnnnnnnnnnnnnnnnnnnnnnnnnnnnnnnnnnnnnnnnnnnnnnnnnnnnnnnnnnnnnnnnnnnnnncaggtctgcctcttcgctggcggcctctaccgctgtgcctgtncnnaannntncnnnnntnttccnnatnntnnnnnncnnnncnnnnncnnnnncgccannctgaangattgctcgnaaaatgcaatttgcatggacacccacgagggctacacntgccgttgccgacccggcttcntggacatctccccgganccnnacaaananccgggccgantctgcataccgttngtgaatgaatgcgccaatgcgcagaacgattgctcccagaatgcgntttgcaaggacaccgacgacggctacacgtgccgttgccgggccggcttcntggacgtgtccncgnatgctggcaaanagccgggccgantgtgcattgaggtggtnaacgagtgcgcggaggccgagctgaacgactgctacgagaatgccatttgcaaggactcgccngagggctacacntgcaaatgcnggcccggctttgtggacgtgtccccgaangaagccnagnaaccgggcagaatgtgcncgnnnnngncaannnnnccgnnnnagnannnnnanctgatttttctcattgacggttcgggttctattggttcccaggtgttccgcaatgagattcttcgcttcatcaaagaattcattgaactttttgacattgggcttgacaatacaagggtcggcttgattcaatattcggatcaaattcgccatgagttcaacttgaaccagtacacggacaaaccatccctgctttctgccattgatcatgtacaatacttgactggattgacaagnaccggcgcagcaattcaacacttggtcagcgaaggcttctccgaccgtcgtggcgttcggccactttcggaaggtgccaaccgtgtggctgttgtgatcacggatggaagaagccaaacnaatgtcacgcaaccggcaaaatcggctcgcgcactgcaaatcaacacatttgccattggtgtcactgatcacgtttcagcaacagaattggagttgattgctggatcgccaaatcgntggttttatgtggaaggcttcaaggacttggacatgcgtctgcgttcactggttcagaaactggcatgccctccattgcctcatgttccaatgaacactgtgggtggatgcnacccnnanncncagacnggntgtgacngnncannnnnnnaantttgngngcnnntnnanngnangncnacntgncnntgcccnnncgnntttgcncnncatccgcnnacnnangtntgtggcggtganntntgcaatccnganntgncaacntcntgcccncatccngagaattgtcggcgcaccccgtttggcaactaccgttgcgtttgccctgccggattccaacgtgatggccactttggcgcgtgcatttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctcaggcaaatgtcttgcccctggtgcctgcgacccatccgatgcaaattcttgcgatcttcgcaaacgcgaacgttgcatgcctnnnnnnnnnnngcannnnnnnnnnnnnnnncngggnganaancggcatcccgttncgnaggtttgattgnggaacgaatgcgtgangggnnagcatgactgcgacccgaatgccctatgcatngacaccgacgacggctacacgtgccgttgccgggccggcttcttcgacatntccccggatcccganaaaangccgggccgagtctgcgttgangtggtcaacgaatgcctggacgcngagaacgattgctccccgaatgccanttgcatggacaccgacganggctacacgtgccgttgcnngcccggctttttggacgtgtcgccggatccagngaanaagccgggccgagtgtgcnaancgctggtgaatgagtgngccaagccggagctgaacnattgcgacccnaatgcnatttgcgaggatacngacgacggctacacgtgccgttgccagcccggcttcgtggacntgtccnagcagcacaanccgggccgacnctgcgttcggntggcngtcgaggaatantncgatgccgagctgaacgantgcnancngaatgcactttgcanggacgacgccgaggacggctacacgtgcgattgcnggcccggcttcntggacatgtccccggagncnaacaaaccgggccgagtctgcgttgnggtggtnaacgaatgcgtgnatgccgagctgaacgattgcgactcgccggataatgcaatttgcgaggattccnaggaaggcttcacgtgccgttgcaggcccggcttcgtggacatttccccggaanncaacaaaaaaccgggccgagtntgccaagaggtggtcaacgagtgtgcnaaggccaagctgaattgttgccaggagaatgccatttgcgaggacacncccgaaggctacacgtgccgttgccggcccggcttcgtggacgtgtccncggaccacaacaaccagccgggccgaaactgccttcngttngtgaacgaatgcaancnggcnaagaacgattgctccnaaaatgcnatttgcgaggacaccgaggaaggctacacgtgcgattgccggcccggcttcntggacgtgtccccggacaccgtnaaacagccgggccgaanctgcgttgagagcgtgaangaatgcgtngaggcccagaatgactgctcgcngaatgccanttgcgntgacaccccggagggatacacttgccaatgccgtgccggctncatggacgtttcgccngacnctggcaaacagccgggccgagtntgcnaacaggagntggaggacgantgcgacncgggncagnacgattgctacccgaatgcnanttgcaaggacacgcccgaaggctacacgtgcnaatgccngcccggcttcgtggacgtttcgccnaatccagncaagcagccgggccgngtntgcctaccnaggncaantnnaccgncnnannnnnnncngnnnannngnngnaaannnnnnnannnnnannnnaaggangnnngcnnnnnnnnnnnnngnnnnccnngntncncnnnncncnnnacccanggccaagcgccggctggtngntgtncantgatcaacgagtgcttggacccggagctgaacgattgccatccaaatgcgaattgcatggacatgcccgaaggctacacntgccnatgccgtgccggcttcgtngaccagtctccagataaaaagccgggccgantctgcnnncngatggtgaatgagtgcgcgaagccggagctgaacgattgcgaccaaaatgcnaattgcgagganacggacgaaggctacacgtgccgttgccgtcccggcttcntcgacanctcgccnaaccagccgggccgtntctgcattcaggtggtgaacgaatgcgtgganccggagctgaacgattgctccccgaatgccaattgcatggacaccgaggagggctacacgtgccattgccggcccggcttcgtggacgtgtccccgaatgccanacanccgggccgagtgtgcntngngntggtnaacgagtgngtgaaggcggagctgaacgattgctcccaaaatgcgnattgcaaggactcgccggagggctacacntgcatttgcnggcccggcttcatggacntgtccccggacnccaagaanccgggccgagtttgcctagcgctcgtgaatgaatgcgacaagggcctgaacgattgcgacccgaatgccaattgcnatgacacncncganggctacaattgccgttgcccncccggctncnttgacgaatccccgganccagagaaccagccgggccgagtttgcatngcgttggtggacgantgcgaaccgggncagcacgattgctccccnaatgcnatttgcatggacacgcccgagggctacacgtgccattgccgggccggctnngtggacgnntcgcccaatccngngaagaagccgggccgagtttgctcngtgcagnaagcatgcccggccnngcacgattgtagnncaattgcggtttgcnaggatcnaggggacgacgggtacanctgcatttgcatnccaggctncattgaccagtcgccngacnacaaaccnggccgnatttgcgtacgcntgnatgaatgcgncgatccgnanctgaacaattgctcnnnaaatgcggnttgctacgacaaggaggagggctancngtgtgattgcaaacccggctncnttgatgnctncccagacnnacannanccnggccgngactgccaacngccgggacgtgttnncgcnccgaagnaccacacttgtttggannncnncaaaaangattgccatccnnnngcnanttgccaagagtccagtcccgaagncttcacgtgccnttgccgggccggcttcntngacaaatccccggatccagacaaaaagccgggccgagtntgcgttgagctngtgaacgaatgcgtggatcccgngctgaacgattgctaccagaatgcaatttgcaaggacanggatgccnacgagggcttcacgtgccgttgccggcccggcttcgtggacatgtccccggatccngacaaaaagccgggccgagtttgcgttgagctggtnaacgantgcgnggatccggagctgaacgattgctatcagaatgcaatttgcnaggactcgccggagggctacacgtgccaatgccggcccggcttcctggacaaatccccggatnccaanaagccgggccgagtttgcanagcgctggtgaatgagtgtgccaagccggcgctgaacgattgttgcccaattgcgaattgcaagganaagcccgangggtacacgtgccnttgccaacccggcttcattgaccagtctcccnacaagccgggccgantctgccancagatggtgaatgagtgcgcgaggccggagctgaacgattgngaccnaaatgcgaattgcaaggacaaggnggacggctacaantgcgtttgcccacccggcttcatggaccagtccccgnacnanccgccgggccggatttgcctngtgaacgaatgcntcaatccggcnctgaacgattgcgacccaaatgcggattgcnangacnagnnggagggctacacttgcgantgccgncccggcttccttgacgattcgccaaacgnnaaaaanccnggccgantttgcntgaagctngtnnatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaatacagatatggcaacagcagcaaaccagcatatgtggaattctcacaaggattcaacaaggatttgggcaaggctgtgagttccacggcatacactcgacgctacattctaactgatgtcaactatatgacacatccgaagaccttgaatagntcttggccagacggtctcctcgtgaatttcacggttnnnggccttcgcccagaagaacagccaaccgatgtttgcgacttctggaatcagctgatggaatccattcaaaaaaccaatggtcaaattggcgggggcaagttgaagacggccagtgacattgaattgctttctccttgtnnnnnnnnnnnnnnnnnnnnnnnnnnnnnnnnnnnnnnntgccgttccgatttgggcgaattcctgattggcggcgaagtctgcggctgtccgcaaggccaaaagcgtgccggtccagacgaccattgccgagtggttgagtcttggacatggccaatttgggtgatccgcaagaaccaatacacgctggatttcaatgaaacttttgccaacccattggacgcactttacaancaatacgtgcaatcctttgaaggaggtgtccgtcaaagctatttgcaaactccantnngnnntncnttngtnncnnccgaagtcanngacntnctgnanccgnnnncnataaacgccagctggacagaaggcctcctcttcaacgccacaatgcatttccgcaaaggcgcagtcaagaacgcggcggacgcgtacgatcttctgatacgctacgtgctggacaggaatgggcatcagttgggcaagtctggcctctacttgagccaatggcaacaaaatccgtttggcgcgtgcttcaagaatnaatgcganccangtgcccnctgcgttgangccgnctcnaatgnntacagctgtgaatgcncacccggcnaangtgacctgnntccggnggatcccggccgaaaatgngtgcccatccagggcnncaatgagtgcgaacggnaggaggacaacgantgcnntgagaatgcgcnatgcattgacntggannagnnntactattgtgnttgcttgcccggcttntcggannacacccccaanggggcaatcccgggcagcgtttgngtgntngactantgcanngacgtgaacttctgcncnggcaacancanttgcntgaacatngaacancnggcngagtgcnnttgcaagccnnnntntgtggacatccgnnnnnnnnnannacgnntnagcatnggnntnnggccngancantattgcntnnnngcncntgacgtggatgaatgtgcgttgggactgcacgactgtncnnccnangcgcantgcacgaacttncccganggctacncgtgcnnntgtncnnnngnntnnnnngatggaaatcaggaattgccgggccgcatttgtgccagcaaactgtgcgacaaatgcaatgagcatggcgaatgcaaaccggatcccctgagcacatccgtcatttgtgaatgccatgagggctacagcggccaattctgccaagttgcaccctcaacggcacccctgattcttctcattttgttggcattgttgttcttgttgctcacacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 320 - DNA, 1401 bp, Artificial Sequence
  Description of Artificial Sequence: Synthetic polynucleotide
  modified_base (31)..(36): a, c, t, g, unknown or other
  modified_base (157)..(660): a, c, t, g, unknown or other
  modified_base (693)..(693): a, c, t, g, unknown or other
  modified_base (766)..(768): a, c, t, g, unknown or other
  modified_base (972)..(972): a, c, t, g, unknown or other
  modified_base (1396)..(1401): a, c, t, g, unknown or other
atgggtgattttgtgccgaaatttgaacgtnnnnnnaatatggataagaccatgggtccccgaccattgccaacagctggagcaattcccatcaaggacgagaaaggacgtgttataatgaagaaggtgaaggttcagcgatatatggccggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccctcgacttaaacctgtttttgttccaaanaacgatcgagtgactctgattgaactggagaaggaacaagccaaactggaacagttgcggatggaagaggagnnncgcaaagaagagaagaagcgcctgaccgcaaaagttttggaagagcaaatgaagagggaggcggaactcgagaaggcaaagaaggaggaaaaaactcgattgactgccattaacacggacgatgaaagcgaagaaattgcctatgagatgtggaaagtgcgcgaaatgaagcgactcaaacggaatcgggatgagcgtgaagcnttggctcgcgagaaagaggaattggaccgcatccataacatgacggaggaagagcgtcgcgaatatatgcggttgcatcccagaatcatcaccaatgaacagcacaaaggaaagtacaaattcctgcaaaagtactaccaccggggtgtcttcttcctggacaaggaggatgaagtgcttaaacggaactttgccgaggccacgggcgaagaccagttcgacaagtctttactgcccaaagttatgcaggtgaaaaatttcggcaaagcgagtcgttccaaatggacccatttgaccgccgaggacaccaccgaccatcaaggcgtttgggccacaccaacggcattgagcacaaaattcgtgacaaaacacgcagctggaatgaagagtgtgtttgagaagccgacagtgaagaagcgaaaannnnnn

SEQ ID NO: 321 - DNA, 2472 bp, Artificial Sequence
  Description of Artificial Sequence: Synthetic polynucleotide
  modified_base (1)..(30): a, c, t, g, unknown or other
  modified_base (340)..(345): a, c, t, g, unknown or other
  modified_base (430)..(1221): a, c, t, g, unknown or other
  modified_base (1258)..(1259): a, c, t, g, unknown or other
  modified_base (1261)..(1264): a, c, t, g, unknown or other
  modified_base (1277)..(1277): a, c, t, g, unknown or other
  modified_base (1279)..(1279): a, c, t, g, unknown or other
  modified_base (1281)..(1281): a, c, t, g, unknown or other
  modified_base (1291)..(1291): a, c, t, g, unknown or other
  modified_base (1293)..(1293): a, c, t, g, unknown or other
  modified_base (1300)..(1301): a, c, t, g, unknown or other
  modified_base (1326)..(1326): a, c, t, g, unknown or other
  modified_base (1341)..(1341): a, c, t, g, unknown or other
  modified_base (1362)..(1363): a, c, t, g, unknown or other
  modified_base (1371)..(1371): a, c, t, g, unknown or other
  modified_base (1380)..(1380): a, c, t, g, unknown or other
  modified_base (1398)..(1398): a, c, t, g, unknown or other
  modified_base (1401)..(1401): a, c, t, g, unknown or other
  modified_base (1414)..(1414): a, c, t, g, unknown or other
  modified_base (1422)..(1422): a, c, t, g, unknown or other
  modified_base (1437)..(1437): a, c, t, g, unknown or other
  modified_base (1440)..(1440): a, c, t, g, unknown or other
  modified_base (1461)..(1461): a, c, t, g, unknown or other
  modified_base (1467)..(1467): a, c, t, g, unknown or other
  modified_base (1483)..(1483): a, c, t, g, unknown or other
  modified_base (1511)..(1511): a, c, t, g, unknown or other
  modified_base (1523)..(1523): a, c, t, g, unknown or other
  modified_base (1527)..(1527): a, c, t, g, unknown or other
  modified_base (1548)..(1548): a, c, t, g, unknown or other
  modified_base (1551)..(1552): a, c, t, g, unknown or other
  modified_base (1554)..(1554): a, c, t, g, unknown or other
  modified_base (1557)..(1558): a, c, t, g, unknown or other
  modified_base (1563)..(1566): a, c, t, g, unknown or other
  modified_base (1570)..(1570): a, c, t, g, unknown or other
  modified_base (1591)..(1591): a, c, t, g, unknown or other
  modified_base (1593)..(1593): a, c, t, g, unknown or other
  modified_base (1603)..(2280): a, c, t, g, unknown or other
  modified_base (2377)..(2472): a, c, t, g, unknown or other
nnnnnnnnnnnnnnnnnnnnnnnnnnnnnnttcagatcagtgctttcggatctgaccagaaatgacaaaacccagatcaatctgctcacaattctggccgaagattacgcctcgttttccagtgatattgtcaaagtcattgaggattcacttaatacgtgtacggtcccgttgaagattgtcatgctctacgtgatcgattcaatcgtgaagaacgtcccaacgagtggcggctaccgcgaactgttttccaagaaaatcgttgaaatgatagtccatgttttcaaagagagcgatgaaaagacgcgagcatccatatacagactgcgcctcacctggnnnnnnaccgacatcttccccaaatccaagctgtacatgatcgacacccgcatcaactcaatcgacaaggcatggccaatcctgaatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcctgagaataatcggatctttgtggatggaaaanntnnnnaggttttcttccncnangaggtggctntnattgaanncaatggcctgccccatcgtgtctcnttcgctggccctccncgggacgtcataatcgacggnnttgcccancgcatggcnttcggcgagcagaagcangtnctcatcgatggcnaagtccangtgcttcgattcggngcnccatcccgtgaaatctacatnggcagntatccattcaaagggnttttcggaggcccgcccattattgcgancatcaacaacanccgncacgaaattcgtctttgtggnccnncnccnnaagtnnnnatcnacccagagccaagctatgagntnatgaggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgcaaagtttgccgcgagcaattcgacgagtattgggacgaagaggaggacgtgtggcgccttcgggattgtatggttttggacgggaaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 322 - DNA, 2178 bp, Artificial Sequence
  Description of Artificial Sequence: Synthetic polynucleotide
  modified_base (1)..(93): a, c, t, g, unknown or other
  modified_base (522)..(522): a, c, t, g, unknown or other
  modified_base (525)..(525): a, c, t, g, unknown or other
  modified_base (534)..(534): a, c, t, g, unknown or other
  modified_base (546)..(546): a, c, t, g, unknown or other
  modified_base (550)..(550): a, c, t, g, unknown or other
  modified_base (564)..(564): a, c, t, g, unknown or other
  modified_base (570)..(570): a, c, t, g, unknown or other
  modified_base (591)..(591): a, c, t, g, unknown or other
  modified_base (607)..(609): a, c, t, g, unknown or other
  modified_base (630)..(630): a, c, t, g, unknown or other
  modified_base (651)..(651): a, c, t, g, unknown or other
  modified_base (660)..(660): a, c, t, g, unknown or other
  modified_base (678)..(678): a, c, t, g, unknown or other
  modified_base (768)..(768): a, c, t, g, unknown or other
  modified_base (786)..(786): a, c, t, g, unknown or other
  modified_base (801)..(801): a, c, t, g, unknown or other
  modified_base (807)..(816): a, c, t, g, unknown or other
  modified_base (831)..(831): a, c, t, g, unknown or other
  modified_base (957)..(1143): a, c, t, g, unknown or other
  modified_base (1210)..(1212): a, c, t, g, unknown or other
  modified_base (1214)..(1214): a, c, t, g, unknown or other
  modified_base (1216)..(1217): a, c, t, g, unknown or other
  modified_base (1219)..(1220): a, c, t, g, unknown or other
  modified_base (1223)..(1223): a, c, t, g, unknown or other
  modified_base (1226)..(1227): a, c, t, g, unknown or other
  modified_base (1231)..(1234): a, c, t, g, unknown or other
  modified_base (1236)..(1236): a, c, t, g, unknown or other
  modified_base (1318)..(1320): a, c, t, g, unknown or other
  modified_base (1428)..(1428): a, c, t, g, unknown or other
  modified_base (1453)..(1455): a, c, t, g, unknown or other
  modified_base (1726)..(1728): a, c, t, g, unknown or other
  modified_base (1807)..(1809): a, c, t, g, unknown or other
  modified_base (1858)..(1860): a, c, t, g, unknown or other
  modified_base (1953)..(1953): a, c, t, g, unknown or other
  modified_base (2059)..(2178): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctcttgaaagagaaaccgaacaaaagccaatatgaggaatgctgcattgtggtttataatattccggttgttgggtccgatcgattgccaaagcttcgaaatgtcttgtcagggattttttcaatccaaaatgcttacaaatacattcatttccctgttgatgagaatgggaaaaccaagggttattgcttcttggagtaccagagcaaggaggcggcaaatgcagctcaaacgctctgtgatgggtacagattggacaaaaaccacactttctcttcctactcattcactgcactgcgcgaaataaaggaaccgaacgctaattggaaaactcctgagaagcgtccatacatcgatctgggcgacctttggtcatggcttcaaaatccaaagtgtcttgaccagtttgccatccaatacgagacnganggtgggttncagttggatgtnctgncccatgtacgcgcngctgancccattccggtcgagaatgcncaacgcattgtgcgtnnnaattggtccgagaagaatttngagtggtcgccgcatggctcntatttggcnacaattcacagccgagcngttattctgtggggaggacagcaatttctgaaattccaacggcttgagcacgacggcgtcaacaacattgccttctcgccaaacgaaaantatctggtcacctatgcntgtggaccaccatcnatgcgnnnnnnnnnngacaatgagaattgnctgcgcattttcgacattttcacgggcgaaatgaaaaaggccttttccccgtccggaaagtcaacttccaaccgattgcacgaatggccctttgtgaagtggtccaacgatgagaaatattttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagctgaatttggcattctgggaataccctcccgccaaaaaatccgcacattgaggatcttttcgnnntncnngnnaanttnntttnnnnanaagtcgggctcctatttggccgtgcacacggaacgataccagaagatgatacggggaaaggatggagaaatcaaatacacgnnnggagttacttcacacattgacattttcgactgtaccacaaaggatgtttcccatctggcgatgcaactgccagaaccctatgtgaattttgcatgggaaccaaaagcnagcaaattctgcgtgcttgtgggcnnnacaaacaaagtgacgcccatgatcttccaatatgacaaagggaagccggctccccagctaattgccaagcttgaatcgggcaccaacctgaattccatcgagtgggcaccccaaggcggctgtcttaccgttttcggtgtcaactccccgaacagtgttgtctactttgttgatgccaacgccagtgaggccaatcggattcgcacaatcgaacacccaaacctcaatagggccttttgggatccaaccggccgttactttgtgacctgcnnnacctttgaggccaaagcacgctatgaaaccggctaccggatttacaccttcctgggacgtgaactttgcaaggcaaacnnngacacgttgcgtcgctttaaatggcgtccccgtccgcccgtgcaactcnnngaacagaaagtgaaggagatcagaaagtccttgaagcagcaagcgcagaagttcgaggaggaggataagaaggaattgctcaaagtgtcaggngaaattattgaattccggcgcaatgctttggagaaattcgaagatattcgcaaaagaaccaaggagataaatccaagggaacttgaagagcgcatcaaattacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 323 - DNA, 711 bp, Artificial Sequence
  Description of Artificial Sequence: Synthetic polynucleotide
  modified_base (1)..(36): a, c, t, g, unknown or other
  modified_base (363)..(363): a, c, t, g, unknown or other
  modified_base (379)..(381): a, c, t, g, unknown or other
  modified_base (577)..(711): a, c, t, g, unknown or other
nnnnnnnnnnnnnnnnnnnnnnnnnnnnnnnnnnnnccaacgcttgtcagctcaaccgtgatggcggtcacatttgacggtggtgtgctcgttgccagcgatcgcagcgtttttaccggcaagacgcaccgcatgaagaacaccacacgccattacaaagtcaacgaccgctgcgtggtggtcttctctggcgatttcgcggacttccaatggctgcaaaatttccttgaacggaagcaactggaattgcaaaaaggcgaccagtacttgaagccggagatggtgcattcctgcctgacttcactgttctacgcccgacgaagtaaaatgaacccgctctggaacacgattgttgtttgcgcnatgcagcccgtcgaannnttcgatgctggaaactttgagccattcatcggggtcgtcaatatgtatggggtcgcctacaagaccaagtatgtggccactgactttggcgcttttctgctcaaccaaatgctcgagactcgcctgaaagaacccggtggggttttgtcccacgagcaagcggttgaggtgctgaagaaggcgatggaggtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 324 - DNA, 1719 bp, Artificial Sequence
  Description of Artificial Sequence: Synthetic polynucleotide
  modified_base (1)..(135): a, c, t, g, unknown or other
  modified_base (181)..(183): a, c, t, g, unknown or other
  modified_base (313)..(313): a, c, t, g, unknown or other
  modified_base (327)..(327): a, c, t, g, unknown or other
  modified_base (345)..(345): a, c, t, g, unknown or other
  modified_base (354)..(354): a, c, t, g, unknown or other
  modified_base (420)..(420): a, c, t, g, unknown or other
  modified_base (427)..(429): a, c, t, g, unknown or other
  modified_base (438)..(438): a, c, t, g, unknown or other
  modified_base (646)..(648): a, c, t, g, unknown or other
  modified_base (850)..(850): a, c, t, g, unknown or other
  modified_base (853)..(853): a, c, t, g, unknown or other
  modified_base (855)..(855): a, c, t, g, unknown or other
  modified_base (1009)..(1009): a, c, t, g, unknown or other
  modified_base (1012)..(1012): a, c, t, g, unknown or other
  modified_base (1015)..(1015): a, c, t, g, unknown or other
  modified_base (1173)..(1173): a, c, t, g, unknown or other
  modified_base (1261)..(1263): a, c, t, g, unknown or other
  modified_base (1474)..(1476): a, c, t, g, unknown or other
  modified_base (1570)..(1572): a, c, t, g, unknown or other
  modified_base (1669)..(1719): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaagaggatccctcctccccgtccgaatacttccgaatgcggnnngacatgatcgagtcgagacgcgccgccggcgacaacccgttcccgcacaagttcgacgtgtccatctcgctgcaagacttcatcgacaagtacaccctgactgagaagggcaaaatgctggaggatgtgntatcggatttaggncgcatctatctgaaacgngagcaaggntccaagctcatcttctatgatctccatggcgagtgcaaaaagatccaaattctggcgaatgcaaantaccacnnnggcctcgangacttcataaccacccatgaccgaatcaaacggggggacattgtcgccgtcgaggggcacccgtcccggtcgaacacgggcgagctgagtgtggtcccgattgggatgtggttgctgacgccatgcttgcggatgctgccacgctcacattttggcattaagaacattgatgttcggtaccgaatgcgctttctcgacctgatcgtgnnnccacaagtccgtgagaaattcgttgttcgtgccaagatcatcacattcctgcgcaaatacctggatgagcttggcttcctcgaggtggaaaccccaatcatgaaccaaattgcgggaggggcaacggcaaaaccgttcatcacacatcacaacgagttggacatgaacctgtacttgcgagtggcgcctgaactttatcatnagntncttgtggtgggcggcattgaacgtgtctacgagattggacgtctgttccgcaacgagggcattgaccaaacccacaacccagagttcacctcctgcgagttctacatggcctacgcggactaccgggacttgatggatttgaccgaggatttgnttncanaaatggtgatgagcattcacggcacctacaagctcaaataccatccgaacgggcccggcacccaaccagtctacgatgtggatttcacaccgcccttcaaacgtaaattcattctttattttttggaaatgaatttaaaaattcaggttgttacattnttaaatgtaaattttaaagatgcccgcaatttcttcatcaaaattgccgaagaccgcggcattgactgccccgagcccaaaaccacgnnncgtctgctggacaagctggtcggcgaactgctcgagccccggttcatcagccccaccttcctggtcggccatccccaaatcatgtccccgctggccaagtggcatcgccaattcgatggattgaccgaacgctttgaactgttcgtggtgaccaaggagatttgcaacgcgtacaccgaactgaacgacccaatcatccagcgggcccggnnngagcagcaagcgaaggacaaggaggccggtgatgatgaggcccaggtggtggacgagactttctgcacggcactggagtacgggctgccgccannngcgggctggggaatgggcatcgatcggctgtcgatgatcttcacggacagccacaacatcaaggaggtccttttcttcccggcaatgcgtcccgacnnnnnnnnnnnnnnnnnnnnnnnnnnnnnnnnnnnnnnnnnnnnnnnnnnn

SEQ ID NO: 325 - DNA, 1068 bp, Artificial Sequence
  Description of Artificial Sequence: Synthetic polynucleotide
  modified_base (1)..(90): a, c, t, g, unknown or other
  modified_base (347)..(349): a, c, t, g, unknown or other
  modified_base (391)..(391): a, c, t, g, unknown or other
  modified_base (411)..(411): a, c, t, g, unknown or other
  modified_base (438)..(438): a, c, t, g, unknown or other
  modified_base (450)..(450): a, c, t, g, unknown or other
  modified_base (453)..(453): a, c, t, g, unknown or other
  modified_base (481)..(483): a, c, t, g, unknown or other
  modified_base (793)..(1068): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgcctgattgtgttgggaatggccggagccggcaaaacctcatttgttcagtacggatttaattcattaaagcaacattgtcttcccattttaagcattaatttggatcctgccgctggaaaagtcccgttcccggcgaatattgacatccgagacacggtgaaatacaaggcagtgatgcaagagtacgggcttggccccaatggtgccatcctgacctgtctcaacttgctttgcaccaaattcgaccaggnnntctcattgttggagaaacggcgcagcacagttccctatgtgnttctggacacgccgggccanattgaagttttcacttggtcagccagnggggcaatcatnacnggctctttggccaataattacccaactnnntgccaattttgttcccccagtgcccgttcgaccaacccgatcacattcatgtcgaatatgctttatgcctgctcaattctttatcggactaagctgccctttttcttggttcttaacaaggcagatgttgtggatcccgattttgcggtcagctggttgacagactttgagaaattccaggaggccttggacgagagcaattccagtttcgcaaatgatttgacgcgctctttgagtcttgtcctggactccttttaccaaaaactcaactgggtggcgatttcctcgagaacgggcgaaggatttgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 326 - DNA, 2904 bp, Artificial Sequence
  Description of Artificial Sequence: Synthetic polynucleotide
  modified_base (1)..(630): a, c, t, g, unknown or other
  modified_base (676)..(676): a, c, t, g, unknown or other
  modified_base (678)..(678): a, c, t, g, unknown or other
  modified_base (680)..(680): a, c, t, g, unknown or other
  modified_base (702)..(702): a, c, t, g, unknown or other
  modified_base (711)..(711): a, c, t, g, unknown or other
  modified_base (827)..(829): a, c, t, g, unknown or other
  modified_base (831)..(831): a, c, t, g, unknown or other
  modified_base (834)..(839): a, c, t, g, unknown or other
  modified_base (843)..(844): a, c, t, g, unknown or other
  modified_base (846)..(846): a, c, t, g, unknown or other
  modified_base (850)..(1101): a, c, t, g, unknown or other
  modified_base (1150)..(1151): a, c, t, g, unknown or other
  modified_base (1153)..(1153): a, c, t, g, unknown or other
  modified_base (1155)..(1155): a, c, t, g, unknown or other
  modified_base (1157)..(1157): a, c, t, g, unknown or other
  modified_base (1179)..(1179): a, c, t, g, unknown or other
  modified_base (1188)..(1188): a, c, t, g, unknown or other
  modified_base (1304)..(1306): a, c, t, g, unknown or other
  modified_base (1308)..(1308): a, c, t, g, unknown or other
  modified_base (1311)..(1316): a, c, t, g, unknown or other
  modified_base (1320)..(1321): a, c, t, g, unknown or other
  modified_base (1323)..(1323): a, c, t, g, unknown or other
  modified_base (1330)..(1518): a, c, t, g, unknown or other
  modified_base (1588)..(1589): a, c, t, g, unknown or other
  modified_base (1654)..(1848): a, c, t, g, unknown or other
  modified_base (1911)..(1911): a, c, t, g, unknown or other
  modified_base (1915)..(1917): a, c, t, g, unknown or other
  modified_base (2151)..(2151): a, c, t, g, unknown or other
  modified_base (2227)..(2280): a, c, t, g, unknown or other
  modified_base (2436)..(2436): a, c, t, g, unknown or other
  modified_base (2683)..(2904): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcctgggctttagcattgccggaggtgttggcaatcaacattatncngntgatgatggcatctttgtgacncgcattatngaaggctcgcctgcctattttgacggtcgcctccagaagggcgaccaaattctggctgttgacaatgtcatcttcaacagtatcacccatcaatttgctgtgaatacgttgaagannncnggnnnnnntgtnngnctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaaggcctgggctttagcattgccggaggtgttggcaatcaacatnntncngntgatgatggcatctttgtgacncgcattatngaaggctcgcctgcctattttgacggtcgcctccagaagggcgaccaaattctggctgttgacaatgtcatcttcaacagtatcacccatcaatttgctgtgaatacgttgaagannncnggnnnnnntgtnngnctgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagccacgcctggtgcgcctccgaaaaggcgactctggtcttggcttcaacattgttggaggtgaagaanntgaacccgtatacattagcatgattgtgccgggaggcgctgccgatgctagcgggaatgtgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccaaggcaaaacttttacgttcgcgcacttttcgacaatgacccagcccgggatgcagangtgnnnccccatcgttccctttccttccattatggcgatgtactccatgtggtcaatgtagccgatgatgattggtggacggccagaaaagtggcagaaaatggcgatgaaggccctgagggactggtcccatcacggaagcgtgtcgagaagagggaacgccagcgccgtaagcaagtcaacttcaatgccggcagtcaaagtttgggacgaaatgcttcaatgggtggcggcggagtncgtcgaggctccagaagtcagctgtcgttctcacgcaaattccccttcgtgaaatctacagagaaattgaacgagnnnnnnnnnnnnnnnnnnnnnnnnnnnnnnnnnnnnnnnnnnnnnnnnnnnnnnattctcgaaaattcagtcaattacgtgcgacccgtcattgtgcttggcgctctgaaagatcgcatcaacgatgagctggtcacacgtcatcctgacagattcagtagctgcgtgccacgtgagctctaacatatgcctcattaagaaatctcacgncgtgattattacttcgtcagcaaggcggaaatggagcgtgatgtcaagaataatctgttcatcgaagctggccaattccagaataacctgtacggcaccagcattgctgctgtccgggaagtagccgattcgggtcgccactgcattctcgatgtttccggcaatgccattcgtcgtctacagaatacggcacgcatttatccaatagccgtgtttgtaaaaccattcaaccatcatcaattgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 327 - DNA, 1974 bp, Artificial Sequence
  Description of Artificial Sequence: Synthetic polynucleotide
  modified_base (1)..(651): a, c, t, g, unknown or other
  modified_base (889)..(1974): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaacgcaacatcctcgtgttcgacttgggcggcggcaccttcgacgtgtccctgctgaccatcgacaacggcgtgttcgaggtgctggccaccaacggagacacccacttgggcggtgaggacttcgaccagcgcaccatggagtacttcatcaagttgatcaagaagaagacgggcaaggatctgcgcaaggacaaccgggccgtgcagaaactgcgtcgtgaggtgggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 328 - DNA, 1833 bp, Artificial Sequence
  Description of Artificial Sequence: Synthetic polynucleotide
  modified_base (1)..(51): a, c, t, g, unknown or other
  modified_base (138)..(138): a, c, t, g, unknown or other
  modified_base (169)..(171): a, c, t, g, unknown or other
  modified_base (406)..(408): a, c, t, g, unknown or other
  modified_base (567)..(567): a, c, t, g, unknown or other
  modified_base (731)..(731): a, c, t, g, unknown or other
  modified_base (733)..(735): a, c, t, g, unknown or other
  modified_base (738)..(738): a, c, t, g, unknown or other
  modified_base (742)..(742): a, c, t, g, unknown or other
  modified_base (744)..(744): a, c, t, g, unknown or other
  modified_base (747)..(748): a, c, t, g, unknown or other
  modified_base (750)..(751): a, c, t, g, unknown or other
  modified_base (762)..(767): a, c, t, g, unknown or other
  modified_base (772)..(772): a, c, t, g, unknown or other
  modified_base (777)..(781): a, c, t, g, unknown or other
  modified_base (783)..(783): a, c, t, g, unknown or other
  modified_base (786)..(786): a, c, t, g, unknown or other
  modified_base (789)..(789): a, c, t, g, unknown or other
  modified_base (793)..(795): a, c, t, g, unknown or other
  modified_base (798)..(798): a, c, t, g, unknown or other
  modified_base (803)..(804): a, c, t, g, unknown or other
  modified_base (807)..(807): a, c, t, g, unknown or other
  modified_base (810)..(810): a, c, t, g, unknown or other
  modified_base (812)..(813): a, c, t, g, unknown or other
  modified_base (815)..(815): a, c, t, g, unknown or other
  modified_base (817)..(817): a, c, t, g, unknown or other
  modified_base (822)..(822): a, c, t, g, unknown or other
  modified_base (830)..(830): a, c, t, g, unknown or other
  modified_base (834)..(834): a, c, t, g, unknown or other
  modified_base (936)..(936): a, c, t, g, unknown or other
  modified_base (939)..(939): a, c, t, g, unknown or other
  modified_base (978)..(978): a, c, t, g, unknown or other
  modified_base (1006)..(1006): a, c, t, g, unknown or other
  modified_base (1008)..(1008): a, c, t, g, unknown or other
  modified_base (1035)..(1035): a, c, t, g, unknown or other
  modified_base (1134)..(1134): a, c, t, g, unknown or other
  modified_base (1161)..(1161): a, c, t, g, unknown or other
  modified_base (1164)..(1164): a, c, t, g, unknown or other
  modified_base (1197)..(1197): a, c, t, g, unknown or other
  modified_base (1381)..(1381): a, c, t, g, unknown or other
  modified_base (1383)..(1387): a, c, t, g, unknown or other
  modified_base (1389)..(1390): a, c, t, g, unknown or other
  modified_base (1392)..(1393): a, c, t, g, unknown or other
  modified_base (1399)..(1401): a, c, t, g, unknown or other
  modified_base (1404)..(1404): a, c, t, g, unknown or other
  modified_base (1500)..(1500): a, c, t, g, unknown or other
  modified_base (1546)..(1546): a, c, t, g, unknown or other
  modified_base (1552)..(1552): a, c, t, g, unknown or other
  modified_base (1555)..(1558): a, c, t, g, unknown or other
  modified_base (1561)..(1562): a, c, t, g, unknown or other
  modified_base (1671)..(1671): a, c, t, g, unknown or other
  modified_base (1825)..(1833): a, c, t, g, unknown or other
nnnnnnnnnnnnnnnnnnnnnnnnnnnnnnnnnnnnnnnnnnnnnnnnnnncgcattgcaatcgtaaatccggacaggtgcaaacccaaaaattgtgggcaaccatgcaaaaagaattgtccggtggttagaaccganaaacaatgtattgttgtcgaaccgacatcannnattgctgaaatttccgaagttctttgtattgggtgtggcatatgtgttaagaaatgtccttatggtgcaattcagattatcaatttgcctagcaatttggaaaaggagacaacccatcgatacagtgcaaattcattcaagctccatcgccttccaatgccaagacttggttcagttttgggacttgttgggacaaacggcattgggaagtctacagctttaaatattctttcannncgactgaaaccgaatttgggcaactttaagagtccacccgattggccatccattttgacttacttcagaggttcagagttgcagaactattttttgaagcttttggaagagaagtttaaagccataataaagccccaatatgttgatcagattccaaanaagacaatggaaacgatcatcaaagatatgggtaataataataataatttatttacaagattatttgatcaaatttcagaactaacttatttgctcgatcgcgaagttcaaaatttatctggaggtgaacttcaacgagtccttttaacactttgccttggaangnnngcngatntntanntnnttgatgagccnnnnnnttatntggannnnnancancgnttgnnngcngccanngtnatnanngngntgttnaccgaccnaaantatgtgattgttgttgaacatgatcttgccgttctggattatctttctgattacatttgcttattatatggctatccgggtgcgtatggtgtagtaacacanccntgtggtgttcgtgaaggaatcaatcactttttggatgtntttataccctctgagaatatgcgctttngngatgcttctttgtctttcaaagtttcngaagaaagggaagaaataaaacgaacaacccattatgcttatcctgacatgacttacgaagtgggcaaatttcaactttgcattcaaaaaggagatttnaccgattccgaaattatcgttttactnggngaaaatggaactgggaagactacattcataganatccttgctggacaacttaaaccaacaaaatcggatgatgaaattcctgaattgagaatttcctataagcctcaaaaaatcgcgccaaaattcgagggcacagttcgacaactgttgatgaagaagatcccaacattgttcaaccaccccgctttcaaaactgatgtgctcaatcctttgaacntnnnnnanntnntcgatnnngangttcaaaatttatctggaggtgaacttcaacgagtccttttaacactttgccttggaacgccggcagatgtctatcttattgatgagccgagtgcntatctggattcagaacagcgtttgcacgcagccaaagtcattaagnggttgnttnnnnacnnaaagaaaacagcttttgtggttgaacatgatttcataatgagtacctacttagctgacagggttattgtctttgatgggatgcctgcgatcaaagcaaatgcaaatacnccacagacacttgtgactgggatgaatcgcttcttgagtcagcttaacatcacattcaggagagataatgaaagcaacaggccgcggattaacaagaaggattcacagctggatgctgaacaaaagaaatctggagactatttctatctggaannnnnnnnn

SEQ ID NO: 329 - DNA, 1221 bp, Artificial Sequence
  Description of Artificial Sequence: Synthetic polynucleotide
  modified_base (1)..(546): a, c, t, g, unknown or other
  modified_base (723)..(723): a, c, t, g, unknown or other
  modified_base (729)..(729): a, c, t, g, unknown or other
  modified_base (732)..(732): a, c, t, g, unknown or other
  modified_base (741)..(741): a, c, t, g, unknown or other
  modified_base (745)..(745): a, c, t, g, unknown or other
  modified_base (747)..(747): a, c, t, g, unknown or other
  modified_base (964)..(1221): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaacattctttgtgagaaatgcgactgggatctggctgaattcttagagaaaataccccatgacatgtgcaatgcacagtgcaagcattttgctactcagattttttctggaattgattttctccattccaacaatcttattcacagagatttgaagccacaaaatattttggtnaatcgngancaaacattnaggntngccgattttggattgtctcgcaattatggccttcatgcaacactcaccacagaagttgttacactatggtaccgcagtcccgaactattgcttcaatgcaaatacagcacaagtgtggatatttggtcggctggatgcatatttgtggagctttacatgcgaaatgctttcttcaagggtgatacagaggctcaacaattgcgtattatttttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 330 - DNA, 2433 bp, Artificial Sequence
  Description of Artificial Sequence: Synthetic polynucleotide
  modified_base (1)..(18): a, c, t, g, unknown or other
  modified_base (189)..(189): a, c, t, g, unknown or other
  modified_base (204)..(204): a, c, t, g, unknown or other
  modified_base (222)..(222): a, c, t, g, unknown or other
  modified_base (225)..(225): a, c, t, g, unknown or other
  modified_base (321)..(321): a, c, t, g, unknown or other
  modified_base (399)..(399): a, c, t, g, unknown or other
  modified_base (684)..(685): a, c, t, g, unknown or other
  modified_base (687)..(690): a, c, t, g, unknown or other
  modified_base (696)..(697): a, c, t, g, unknown or other
  modified_base (700)..(700): a, c, t, g, unknown or other
  modified_base (702)..(702): a, c, t, g, unknown or other
  modified_base (706)..(712): a, c, t, g, unknown or other
  modified_base (714)..(714): a, c, t, g, unknown or other
  modified_base (720)..(721): a, c, t, g, unknown or other
  modified_base (723)..(723): a, c, t, g, unknown or other
  modified_base (726)..(727): a, c, t, g, unknown or other
  modified_base (732)..(732): a, c, t, g, unknown or other
  modified_base (736)..(736): a, c, t, g, unknown or other
  modified_base (738)..(738): a, c, t, g, unknown or other
  modified_base (741)..(742): a, c, t, g, unknown or other
  modified_base (746)..(747): a, c, t, g, unknown or other
  modified_base (750)..(750): a, c, t, g, unknown or other
  modified_base (759)..(761): a, c, t, g, unknown or other
  modified_base (768)..(768): a, c, t, g, unknown or other
  modified_base (772)..(772): a, c, t, g, unknown or other
  modified_base (775)..(775): a, c, t, g, unknown or other
  modified_base (777)..(777): a, c, t, g, unknown or other
  modified_base (780)..(783): a, c, t, g, unknown or other
  modified_base (787)..(787): a, c, t, g, unknown or other
  modified_base (792)..(794): a, c, t, g, unknown or other
  modified_base (799)..(804): a, c, t, g, unknown or other
  modified_base (807)..(809): a, c, t, g, unknown or other
  modified_base (814)..(814): a, c, t, g, unknown or other
  modified_base (816)..(820): a, c, t, g, unknown or other
  modified_base (1032)..(1032): a, c, t, g, unknown or other
  modified_base (1125)..(1125): a, c, t, g, unknown or other
  modified_base (1134)..(1134): a, c, t, g, unknown or other
  modified_base (1137)..(1137): a, c, t, g, unknown or other
  modified_base (1164)..(1164): a, c, t, g, unknown or other
  modified_base (1200)..(1200): a, c, t, g, unknown or other
  modified_base (1442)..(1443): a, c, t, g, unknown or other
  modified_base (1446)..(1446): a, c, t, g, unknown or other
  modified_base (1452)..(1452): a, c, t, g, unknown or other
  modified_base (1458)..(1459): a, c, t, g, unknown or other
  modified_base (1462)..(1464): a, c, t, g, unknown or other
  modified_base (1467)..(1477): a, c, t, g, unknown or other
  modified_base (1480)..(1480): a, c, t, g, unknown or other
  modified_base (1482)..(1483): a, c, t, g, unknown or other
  modified_base (1488)..(1489): a, c, t, g, unknown or other
  modified_base (1494)..(1495): a, c, t, g, unknown or other
  modified_base (1497)..(1499): a, c, t, g, unknown or other
  modified_base (1503)..(1504): a, c, t, g, unknown or other
  modified_base (1506)..(1509): a, c, t, g, unknown or other
  modified_base (1515)..(1516): a, c, t, g, unknown or other
  modified_base (1519)..(1519): a, c, t, g, unknown or other
  modified_base (1521)..(1521): a, c, t, g, unknown or other
  modified_base (1525)..(1531): a, c, t, g, unknown or other
  modified_base (1533)..(1533): a, c, t, g, unknown or other
  modified_base (1539)..(1540): a, c, t, g, unknown or other
  modified_base (1542)..(1542): a, c, t, g, unknown or other
  modified_base (1545)..(1546): a, c, t, g, unknown or other
  modified_base (1551)..(1551): a, c, t, g, unknown or other
  modified_base (1555)..(1555): a, c, t, g, unknown or other
  modified_base (1557)..(1557): a, c, t, g, unknown or other
  modified_base (1560)..(1561): a, c, t, g, unknown or other
  modified_base (1565)..(1566): a, c, t, g, unknown or other
  modified_base (1569)..(1569): a, c, t, g, unknown or other
  modified_base (1578)..(1580): a, c, t, g, unknown or other
  modified_base (1587)..(1587): a, c, t, g, unknown or other
  modified_base (1591)..(1591): a, c, t, g, unknown or other
  modified_base (1594)..(1594): a, c, t, g, unknown or other
  modified_base (1596)..(1596): a, c, t, g, unknown or other
  modified_base (1599)..(1602): a, c, t, g, unknown or other
  modified_base (1606)..(1606): a, c, t, g, unknown or other
  modified_base (1611)..(1613): a, c, t, g, unknown or other
  modified_base (1618)..(1623): a, c, t, g, unknown or other
  modified_base (1626)..(1628): a, c, t, g, unknown or other
  modified_base (1633)..(1633): a, c, t, g, unknown or other
  modified_base (1635)..(1639): a, c, t, g, unknown or other
  modified_base (1797)..(1797): a, c, t, g, unknown or other
  modified_base (1799)..(1800): a, c, t, g, unknown or other
  modified_base (1802)..(1802): a, c, t, g, unknown or other
  modified_base (1805)..(1809): a, c, t, g, unknown or other
  modified_base (1860)..(1860): a, c, t, g, unknown or other
  modified_base (2431)..(2433): a, c, t, g, unknown or other
nnnnnnnnnnnnnnnnnncaaaaagacgagaaaactaaacgaaacgaggagttggcgacagcgattctgaagaacaaaccaaagccgaatcgactcattgtggacaccaatccgagtgatgacaacagcactgtgggattgtcccaggccaagatggacgaactcaacttgttccgtggcgacaccgtnttcctcaaaggcaanaaacgccgcgagactgcngcnattgtgttggcggttgagaactgcgccaacgagaaaatactcatgaaccgtgttgtccgccagaatcttcgtgtcaagctgggcgatgttgtcagngttccggcatcgaatattccaaatggaaaccgcgttcacattctaccaatcgacgacactgttgagggactcactggnaatctgttcgaagtttatctgaagccatactttgtcgagacctaccgaccactctacaaaggcgacacattcactgttagtgcggccatgcgcacagtggaattcaaggttgtggaggtggacccatcacccgcttgtattgtcgcaccttcaacggtcattcactgcgagggcgagccgatcaagcgcgaggatgaggaagggaatctgaatgaagtgggctacgacgacatcggcggaatgcgaaaacaactcgcacaaatcaaagaaatggtggaacttccnntnnnncatccnnaantnttcnnnnnnntnggcatnnanccnnctcgnggantnctnntctnnggnccacccggnnncggcaanactntgntngcnnnngcanttgcnnntgagnnnnnngcnnncttcntnnnnntcaatggccccgaaatcatgagcaaactggctggcgaatcggaatcgaatttgcgcaaggcgttctccgagtgcgagaagaactccccggccatcctgttcatcgatgagattgacgctattgcaccaaaacgtgaaaagacgcatggagaagttgagcgccgaattgtgtcgcaattgcttaccctcatggatggactcaagcagcgttcnaatgtcatcgtcattggcgcaacaaaccgtccgaattccattgacccggcacttcgtcgttttggccgattcgatcgcgaaattgacattcgnattcctgangcnattggtcgtctggaaattctgcgcatncacaccaagaacatgaaactggccgatgatgtgganttggaacgaattgcaaacgaatgccatggatatgttggcgctgacttggccgcactttgctcggaggccgcaatgcaacaaattcgccagaagatggaacttattgacttggaagcggatctgatcgatgctgaagtgctcaaccagttggcggtcacaatggacgacttccagttcgctcttggcaagaacagtccttcggctctgcgtgaaaccgtcgtggaaacaccaaatgtcacttnngangacatnggcggnntgnnnaannnnnnnnnnnaantnnaaganntggtnnannntccnntnnnncatccnnaantnttcnnnnnnntnggcatnnanccnnctcgnggantnctnntctnnggnccacccggnnncggcaanactntgntngcnnnngcanttgcnnntgagnnnnnngcnnncttcntnnnnntcaatggccccgaaatcatgagcaaactggctggcgaatcggaatcgaatttgcgcaaggcgttctccgagtgcgagaagaactccccggccatcctgttcatcgatgagattgacgctattgcaccaaaacgtggcggcaatgttggcgacgcgggngnngntgnnnnncgaattgtgtcgcaattgcttaccctcatggatggactcaagcagcgttcnaatgtcatcgtcattggcgcaacaaaccgtccgaattccattgacccggcacttcgtcgttttggccgattcgatcgcgaaattgacattccgctgccggatgagccaagccgtctggccatcttcaaatcctctcttcgcaaaacgccaattgcggccgatgttgagctcggctatctgtccaaggtgaccgtgggcttctccggcgctgacatcaccgagatttgccaacgtgcctgcaaactggccatccgcgagtccatcgagaagtcgattgcggtcgagaaggagcgacaggccaaaatgcaaaagggcgaggaagtgatggacgatgctcccgccgatccagtgcccgaacttactcgcaaacactttgaagaggccatgaaatttgcgcgccgctccgtttcggacaacgacattcgcaaatacgagatgttcgctcaaacactgcagcagcaacgcggcttcggcaacaacttcaaattcccgggcgagggcggtgctggcggtggcagctctggagctggcggtccggccggaggcaacgatgatgacgacctgtacagcnnn

SEQ ID NO: 331 - DNA, 459 bp, Artificial Sequence
  Description of Artificial Sequence: Synthetic polynucleotide
  modified_base (1)..(18): a, c, t, g, unknown or other
  modified_base (415)..(417): a, c, t, g, unknown or other
  modified_base (457)..(459): a, c, t, g, unknown or other
nnnnnnnnnnnnnnnnnnaagcgtgagcaattttacgtccgttactatgttggacacaaaggaaagttcggtcacgagttccttgaattcgaatttcgtcctgacggcaagcttcgttacgcgaacaattccaactacaagaatgacaccctgatccgcaaggagtgctatgtcagcaaatccgtcatggacgaattgaagcgcatcattgaggactctgagatcatgaatgaagacgacgcaaattggccggaacctgatcgcgtgggtcgccaggaactggagattctgagcggcaacgaccatgtctcgttcacgaccagcaaaattggctgtcttgtggaagtgaatgacagcaaagatccggttggacttcgctcattctactacctggttcaggacctgaagtgcttgnnnttctcgctgatcggacttcatttcaaaattcgaccaattnnn

SEQ ID NO: 332 - DNA, 2949 bp, Artificial Sequence
  Description of Artificial Sequence: Synthetic polynucleotide
  modified_base (1)..(927): a, c, t, g, unknown or other
  modified_base (1216)..(1593): a, c, t, g, unknown or other
  modified_base (1809)..(1809): a, c, t, g, unknown or other
  modified_base (1813)..(1813): a, c, t, g, unknown or other
  modified_base (1821)..(1821): a, c, t, g, unknown or other
  modified_base (1836)..(1836): a, c, t, g, unknown or other
  modified_base (1840)..(1840): a, c, t, g, unknown or other
  modified_base (1845)..(1845): a, c, t, g, unknown or other
  modified_base (1847)..(1848): a, c, t, g, unknown or other
  modified_base (1854)..(1855): a, c, t, g, unknown or other
  modified_base (1857)..(1857): a, c, t, g, unknown or other
  modified_base (1859)..(1860): a, c, t, g, unknown or other
  modified_base (1862)..(1862): a, c, t, g, unknown or other
  modified_base (1865)..(1866): a, c, t, g, unknown or other
  modified_base (1868)..(1871): a, c, t, g, unknown or other
  modified_base (1875)..(1875): a, c, t, g, unknown or other
  modified_base (1878)..(1878): a, c, t, g, unknown or other
  modified_base (1881)..(1881): a, c, t, g, unknown or other
  modified_base (1891)..(1891): a, c, t, g, unknown or other
  modified_base (1904)..(1905): a, c, t, g, unknown or other
  modified_base (1908)..(1908): a, c, t, g, unknown or other
  modified_base (1910)..(1910): a, c, t, g, unknown or other
  modified_base (1912)..(1912): a, c, t, g, unknown or other
  modified_base (1918)..(1920): a, c, t, g, unknown or other
  modified_base (1924)..(1924): a, c, t, g, unknown or other
  modified_base (1928)..(1929): a, c, t, g, unknown or other
  modified_base (1954)..(2949): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaaccgaaccttctttcggcccccagggctcggtccagaaggcgtagatggcggcgagccattcccaacgaatgccatggtctgtccgcactgtggcttctgctgttcctcaaaattccattacaactcgcacatgaatacccacaacatccaacgatgctcaatgtgcaactaccagtctcgtaccgaaggccgtttgaagaagcacatgcaacagtcgcacacgcacgaggacagggtggcagccggcatctgcatatcgccacctccgccccctgcagcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgggcaaaccaaagcagtacaaatgcaagcaatgtccgcacatcagccgcagcaaaaaggaacaatgggcgcatgcccggcttcacattcctcagcagaagcagctgacctgtcaactctgtgactttgtgaccgagtacaagcaccatctggagtaccactaccgcaaccataatggccaaaagccattcaagtgcagcacatgcgcctacaantgcntcaacaantccatgctgaattcncacntgaantnncacacnncngnntntcnntnnnnctgncangantgcacttatnagaccaaatattnncanantnttaagnnncatntgannaagtacaaccacaaaagggcacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 333 - DNA, 1296 bp, Artificial Sequence
  Description of Artificial Sequence: Synthetic polynucleotide
  modified_base (1)..(105): a, c, t, g, unknown or other
  modified_base (429)..(429): a, c, t, g, unknown or other
  modified_base (544)..(546): a, c, t, g, unknown or other
  modified_base (889)..(1296): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacagcccgttctcagttcaaaaaatgcacaattccgaaaaggcactggcggaagggcaagcttttctggcaatgtggtcaccggtttttggcaattctggcttgccggagccggtgtggtgaacagactggcaaaacaaggctgtcaaatgattattccctaccgatgcgatccctatttcgtgaaggagcacaaagtcgtcggcgaacttggccagattttgttctttccgttcaatctgaaagatgagaccagtattcggaaggcagtcaagtacagcaatgttgtcatcaaccttatcggcactttccttcatacaccnaatttttcaccccacgacacaaatgttgaaggggcgcggaggattgcacggatttgtcgcgaaatgggtgtggaacgactggtccatgtgagcgcaatgggcgctgatccggatnnncacaagtcacgctacattaaaaatggccatttcttgcgaaccaaaggccttggagaattggcggtgcgcgatgaattcccgaacgcaacaattgtccgaccatcagtgatgtacggcgaatgcgaccatttcctcttcccatacaccagcttcactcggcgctgtcccatcggcttcgtttacatttacaaaggcggcaaagggatttacaaaatgccagtctatgtcaatgactttgccttgggcattgcccgaatcgccaccgatccagcgatggcagggaaaacattcgaattggttggaccccattgctatgaaatgtgcgaactggttgggtttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 334 - DNA, 1125 bp, Artificial Sequence
  Description of Artificial Sequence: Synthetic polynucleotide
  modified_base (1)..(12): a, c, t, g, unknown or other
  modified_base (174)..(174): a, c, t, g, unknown or other
  modified_base (532)..(1125): a, c, t, g, unknown or other
nnnnnnnnnnnngtcatcaccaaccagccagtggtgatcgacaacggctcgggcgtcgtgaaggccggctttgccggcgaacaatcgcccaaatgcgttttcggcaactttgtgggacgaccaaagcacacccgggtcatggcgggcgcactggagggcgactgtttcattgtnccaaaagcgcaagaatatcgcggcctgttggccctaaaatacccaatggagcatggcattgtgaccgactggaatgacatggaacgcgtttggcagtacatctacagcagtgaccaactcaagtccgaacccggtgaacatcccgtgctgctcaccgaagctccactcaacccgcagacaaatcgcgaaaaagcggcggagattttcttcgagacgttcaatgcgcccgcgctgtacatccaaattcaggccgtcctgagcctctactcttcgggccgaaccaccggggttgtgctcgattcgggcgatggcgtcacccatgttgtgcccatctttgagggtttcgccattgaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 335 - DNA, 3699 bp, Artificial Sequence
  Description of Artificial Sequence: Synthetic polynucleotide
  modified_base (48)..(48): a, c, t, g, unknown or other
  modified_base (283)..(283): a, c, t, g, unknown or other
  modified_base (285)..(285): a, c, t, g, unknown or other
  modified_base (288)..(292): a, c, t, g, unknown or other
  modified_base (294)..(303): a, c, t, g, unknown or other
  modified_base (305)..(306): a, c, t, g, unknown or other
  modified_base (313)..(317): a, c, t, g, unknown or other
  modified_base (319)..(321): a, c, t, g, unknown or other
  modified_base (324)..(324): a, c, t, g, unknown or other
  modified_base (326)..(328): a, c, t, g, unknown or other
  modified_base (330)..(331): a, c, t, g, unknown or other
  modified_base (334)..(335): a, c, t, g, unknown or other
  modified_base (338)..(338): a, c, t, g, unknown or other
  modified_base (340)..(340): a, c, t, g, unknown or other
  modified_base (342)..(342): a, c, t, g, unknown or other
  modified_base (345)..(345): a, c, t, g, unknown or other
  modified_base (348)..(350): a, c, t, g, unknown or other
  modified_base (352)..(354): a, c, t, g, unknown or other
  modified_base (358)..(360): a, c, t, g, unknown or other
  modified_base (376)..(376): a, c, t, g, unknown or other
  modified_base (378)..(378): a, c, t, g, unknown or other
  modified_base (381)..(381): a, c, t, g, unknown or other
  modified_base (395)..(395): a, c, t, g, unknown or other
  modified_base (400)..(400): a, c, t, g, unknown or other
  modified_base (412)..(412): a, c, t, g, unknown or other
  modified_base (465)..(465): a, c, t, g, unknown or other
  modified_base (522)..(522): a, c, t, g, unknown or other
  modified_base (531)..(531): a, c, t, g, unknown or other
  modified_base (544)..(544): a, c, t, g, unknown or other
  modified_base (549)..(549): a, c, t, g, unknown or other
  modified_base (555)..(555): a, c, t, g, unknown or other
  modified_base (570)..(570): a, c, t, g, unknown or other
  modified_base (579)..(579): a, c, t, g, unknown or other
  modified_base (597)..(597): a, c, t, g, unknown or other
  modified_base (626)..(626): a, c, t, g, unknown or other
  modified_base (628)..(628): a, c, t, g, unknown or other
  modified_base (1053)..(1053): a, c, t, g, unknown or other
  modified_base (1081)..(1083): a, c, t, g, unknown or other
  modified_base (1185)..(1185): a, c, t, g, unknown or other
  modified_base (1354)..(1356): a, c, t, g, unknown or other
  modified_base (1744)..(1744): a, c, t, g, unknown or other
  modified_base (1746)..(1746): a, c, t, g, unknown or other
  modified_base (1748)..(1748): a, c, t, g, unknown or other
  modified_base (1754)..(1759): a, c, t, g, unknown or other
  modified_base (1809)..(1809): a, c, t, g, unknown or other
  modified_base (1815)..(1815): a, c, t, g, unknown or other
  modified_base (1881)..(1881): a, c, t, g, unknown or other
  modified_base (1893)..(1893): a, c, t, g, unknown or other
  modified_base (1914)..(1914): a, c, t, g, unknown or other
  modified_base (2256)..(2256): a, c, t, g, unknown or other
  modified_base (2416)..(2418): a, c, t, g, unknown or other
  modified_base (2482)..(2736): a, c, t, g, unknown or other
  modified_base (2917)..(3024): a, c, t, g, unknown or other
  modified_base (3055)..(3055): a, c, t, g, unknown or other
  modified_base (3063)..(3063): a, c, t, g, unknown or other
  modified_base (3084)..(3084): a, c, t, g, unknown or other
  modified_base (3090)..(3090): a, c, t, g, unknown or other
  modified_base (3102)..(3102): a, c, t, g, unknown or other
  modified_base (3114)..(3114): a, c, t, g, unknown or other
  modified_base (3124)..(3124): a, c, t, g, unknown or other
  modified_base (3195)..(3195): a, c, t, g, unknown or other
  modified_base (3270)..(3270): a, c, t, g, unknown or other
  modified_base (3301)..(3301): a, c, t, g, unknown or other
  modified_base (3337)..(3420): a, c, t, g, unknown or other
  modified_base (3607)..(3609): a, c, t, g, unknown or other
  modified_base (3694)..(3699): a, c, t, g, unknown or other
atggctttattgaagaaatttgaatcgaaaagcgcaagagtgaaagcnatttcctttcatccaactcggccatgggttttggcctctttgcacagtggtgtcatccaactttgggattatcgaatgtgcgtgttaattgacaagtttgatgaacatgatgggcccgttcggggcgttgatttccattctcaacaaccaatctttgtttccggcggagatgactacaaaattaaggtgtggaattacaaacagcggaagtgcattttcacactgctcggacatntngannnnntnnnnnnnnnntnnttccacnnnnnannnccntnnntnnttnncgntncngangannnannngtgnnnatgtggaattacaaananagnaagtccattgcaanacttngaggacacaacnattatgttatgtgcgctcaattccatccaagcgaggatttggtggcaagtgcnagcttagatcagactgttcgaatatgggatatcagtgggttgaggaagaagaacacngctcctggnggaggacccggtntgccnagtgtntctgcacaaaccganttgttcggncagcccgatgtagtggtnaaacatgttctggaagggcatgaccgagntntgaactgggtgtcattccacccgacaatgccattacttgtttccggtgctgacgacagacaagtgaaaatgtggcgttacaatgaaagcaaggcttgggaagtggatgcttgtcgaggccactacaacaatgtttcatgcgtcattttccacccaaaagcggaactgatactttccaattccgaagacaaaagtattcgtgtttgggacatgcaaaagcgcacttgtcttcagaactttcgacatgagaacgatcgtttttgggtgctagccgcacatccttccctgaatctctttgctgctgggcatgacaatggaatgattgtgttcaaaacagaacgcgaacgaccaccttattgtgttcatgagaattttgctttttatgtcaaagagaagcaaatgcgacgccttgatttgacaacaaanaaagacacggcattggctcaacttaaannngccaacaaacttacacagccattttattcgctgcattataatccggccgagaattgtttcttgcttgttacgcgcccttccaataacattgaaatagcacancaaaattatttacagatttcttcaaaagaaggtgaacttgagccggcagaggtgaagtcgcctggaatagcagctatatgggtggccagaaaccgatttgctgtgctggacaaaacacaccaattgacaatacgcgatctgcaaaatcaagagagccgaaaaattgatnnntacaacgggcctgtcgatgacattttctatgctgggaccggcttgctattgctcaagaatccggacaatgtgcaaatgtacgatgtccaacaaaagcgcatcctggccactttgaaagttagcaaggttaaatatgtaatttggtcgaagaatatggaatttgcggcacttctcagtaaacacacagtcactttggttaccaggaaattagagttgctttgctccgtccaagaatcaacgcgtgtgaaaagcggtgcttgggatgacaacgatgcgttcctctacacaacatcaaaccacataaaatacgcactcacgggcggagatcacggcataatccgcacaatggacattcctgtgtatatactcgctattcgcggcaatcgcntntnttgttnnnnnngagaggcggcaccaatcgaattgacaattgatccgactgaatatcgcttnaaattngcattaatccatcgacgatatgatgaagtcctgaacatggtgcgcagtgccaatttggtcggccantcaatcatagcntttctgcaaaagaagggctancccgaggttgctctccactttgtgaaggacgaaaagacccgttttggattggcacttgaatgtggaaatcttcagattgccatggaagcggcaaaagttctagatgacaaagccgcatggactgccctgggcgaagctgctttaatgcaaggcaaccaccaaattgtggaaatggcttatcaacggacaaaagattttgagcgattggcattcctttatttgatcacaggaaacacggagaaactgcaaaaaatgcagaaaattgcacaaattcgaaaagatgttcatggccagttccaatgtgcgctcatgcttggcgatgctgaagaaagaacaaaagtnttgaaagaattgggacaacttccattggcctatctctcagccacaaccaatggtcttcaggaggaggcagcacagttgggtgctgagctcgagcaaaaacacatttcaattcctgacacaaaccccaatgcccaaccattggtgccgccaaaaccaatcnnnaacatggtggaaaattggccacagctcactgtatcgaccgggccttttgatgcacaattgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtgtacaccgtgccacagcgtggacatccacccccattttattggccaggaaattcacgtctagtcgctgaccatgttgcagcaggcaattttgacacggctgcgagaatactcgaggaaaccatcggcgctattcagttgggcccattcaaagcacttttcttatcaatttatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcttcagctaaatgatttggcccaacgtntgcaaatntgctatcagctgaccacacanggcaanttcggcgatgcngttcagcgtttncgacaaatantacttgccattcctttgctagtggttgattcaaaacaagaggtcatcgaggcccagcaattgctgcaaatntgtcgcgaatatttggttggtttgttgctggaatcggcgcgcaaagaacttccgagagagtcggtcaatgatgcnaagcgcaatctggaaatggccgcctacttcncgcattgcgaaatccagcctgtccataaaatcttgnnnnnnnnnnnnnnnnnnnnnnnnnnnnnnnnnnnnnnnnnnnnnnnnnnnnnnnnnnnnnnnnnnnnnnnnnnnnnnnnnnnnggaccaaaaccagaaattgcggcccaaatgagaaaaatgctcgcagtagcggagcgagacaacagcaatgcttttgagttgaattacgatgagcacaatccattcgtgctctgttcccgcactttcatgccactctaccgaggcaaaccccaagtgaaatgtcccttctgcggtgccagctactcgnnnggccacaatggcacagtctgtgatgtttgtgaggtggccgaaataggcaaggatgtgcagggactgcgaatttccactgtgcaannnnnn

SEQ ID NO: 336 - DNA, 528 bp, Artificial Sequence
  Description of Artificial Sequence: Synthetic polynucleotide
  modified_base (1)..(135): a, c, t, g, unknown or other
  modified_base (391)..(528): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgatgaccgtctcgatgtgtggtacccatcggttcgtttccgcgcaaatgatgcggtgatcacaccaattcgagagaaggaacttggcgattggaggaacatctcgctggaggagaagaagctgctctaccgctactcataccagtcaactctggccgagtttgaggcacccgatggctattggaaattggactgggcttggtttttctacatcacttcaatcggcatcctgttcatggtgctagagcaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 337 - DNA, 2163 bp, Artificial Sequence
  Description of Artificial Sequence: Synthetic polynucleotide
  modified_base (150)..(150): a, c, t, g, unknown or other
  modified_base (162)..(162): a, c, t, g, unknown or other
  modified_base (180)..(180): a, c, t, g, unknown or other
  modified_base (243)..(243): a, c, t, g, unknown or other
  modified_base (304)..(304): a, c, t, g, unknown or other
  modified_base (308)..(308): a, c, t, g, unknown or other
  modified_base (496)..(496): a, c, t, g, unknown or other
  modified_base (694)..(861): a, c, t, g, unknown or other
  modified_base (1021)..(1341): a, c, t, g, unknown or other
  modified_base (1474)..(1863): a, c, t, g, unknown or other
  modified_base (2041)..(2049): a, c, t, g, unknown or other
  modified_base (2158)..(2163): a, c, t, g, unknown or other
atggcccatctcattgacggctttgtggtcaacgacgccaaatggaagctgggcattttcatcacggacctgaacatttcgcgcgagattctggtgaagggcgacctcaccattggcaacctgatgatgcagctggttgagcaaatagcngaaaaccaggantggagtgaccacgccctntggtggcccgaccgtcgaaaatggctgaaacacacgcgcagcactctcgaccaaattggggtnactgctgccacctttctggagttcactccaatgcataaagcggcccgggttgagctgccgnatcntcaggttttggacgcccgccttgacttctcggtccccgtcctgaaagtgacccaaaagctgtgccaagagctgggcattcgccacccggaagagttgtcgttgaagcgggacattccggccgacattttgcgcaagggcgcacatgttgagtccgacgcggagatcaagccgtacatgaagcccgggnaggaatccattggccccggcacgttgcgcaccgccaagccaatccgtgcctcaaccatgaatttgagcggacgcggctctcccatctcgggcgcctcccacatggggggccatttgttcaatgcgtccgagattggaaccctgccgaaagcgggcacaattccacgcgggatgagcccggggccggctgcggtgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttaaattttttcagctccctgatggagcaaggcatcttcgagggagacactgtgctgctgcgcttcaagttcatgaccttcttcgacatcaacctcaagtacgacccggtccggatcaaccagctgtatgagcaggccaaatggtcggttctgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactcggccactactacatgaagggctgtgaggtggcccaggagctgaacgttccacagggaaaatttctcatcaagctgcagctgcccagcagtgagggaatgaccgaaatgcatttgaagtgtgacacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaagcccgaactgatcgctgtgacccacaaccggatcatgaaggtgaacagcgacaacggcgagtccaacaaaacatggcgttttgcgggcatgaagaagtggcatgtgaactgggagatccggcacatcaaggtgcagttcgacaccgaggacatcgagttcaagccgttgtcgnnnnnnnnncaggtggtccacgaattcattggcggctacattttcatgtctctgcgcagcaaggaccagaaccaggcgctggacgaggagggcttccaccggcttaccggaggatggnnnnnn

SEQ ID NO: 338 - DNA, 3279 bp, Artificial Sequence
  Description of Artificial Sequence: Synthetic polynucleotide
  modified_base (1)..(1149): a, c, t, g, unknown or other
  modified_base (1486)..(2022): a, c, t, g, unknown or other
  modified_base (2227)..(2547): a, c, t, g, unknown or other
  modified_base (2761)..(2865): a, c, t, g, unknown or other
  modified_base (3061)..(3279): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggctgcaagcgccaaatggaaccgctaatccatgacattgtcaatcaagtgctgcctagaatcaccgacgcccacccgcgcgttcgttacgcggtttgcaatgcgattgggcaaatgtgcaccgactttgcgccgaccatccagaagaagtgccacgagcgcattgttccggctctattgacagcaatgtccgatctgaccactcctcgagtggctgcccatgcagctgctgcaatggtcaacttctgtgaggactgcccgaagaatatcatttctatctacttgacaccggtattttccaaaaatttactataaatttcctttattttcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtctgctttgcgcgtgaactgtttgtcagttttgccggctatgtggaaagcattctgaatatgatgctgcccatgctgcgattcgtcttccacgatggtgtgcgttcagctgccgccgaatgtctcccctgtctgatggtttgcgcaaaggggaatggcgaggagtacctcaagcaaatgtggaccgtcattttggcagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatcagatggttcaccaatttttcggcattgttggacggacgaagacccttccaagaccgccaatggggcatttgcatttttgacgatctgattgaatacgggggacaggccagtcttcactaccagaacattttcttccaaccatttgtgaacgcactgagtgacaaataccccgaagttcgacaagcagccgcctatgggtgcggcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggacacaacagcaaccgagaatgcaatcagtgcggtcgccaaaatcctcaagtacaactcgtccgccgttgccaacccgaatgagattgtggcccgattcgtggaatggctgcccgtttggaatgaccaggaagaggttccctatgtttacgactacttctgcgacttggtggaagcccagcacccggcgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 339 - DNA, 1149 bp, Artificial Sequence
  Description of Artificial Sequence: Synthetic polynucleotide
  modified_base (186)..(186): a, c, t, g, unknown or other
  modified_base (859)..(1149): a, c, t, g, unknown or other
atgggcattaaagacctgtctaaggtgattgctgatcattgtcctgctgccataagaacaaatgaaatgaaggcttattttggcaggaaaattgcgattgatgcctcaatgagtctttaccaatttctgattgctgttcgccaggatggacttcaattgaccaatgccgacggagaaacgaccagncacatcaatgggatgttttatcggaccatacggatgatggagaacggcattaagcccgtctacgtttttgatgggaagccgccagagttaaaatccgaagagttggggaagcgcacagaaagacgtgctgaggcaaaagagcaacttgctgaagcaaccgagaagggcgacaccgcggcaatggacaaatttgaacgacgtcttgttcgggtcacaaaagaacaagcggatgagtgcaaacatttgcttactctgatgggtgttccggtcgttgatgctccatgcgaggctgaagcacaatgtgcagagcttgtccgtaaaggcaaagtctatgcaacagccaccgaggacatggacgcactcactttcggctcacaaattctcgttcgtcatatgacattcagtgaggcgaagaaaatgccaatcaaggaattttcattggagaagattttacgcgacattgaattcagccatgaacaatttgtggatttgtgcattcttttgggatgcgattattgtggcaatgtgaaaggaattgggccaaagaaggcattcgaacttatcaaacagcacaagaacatcgaaaccatgctggaaaatattgaccagaagaaatatccagctcccgctaactggaaattcaaggaagcgcgtgaactgttcataaagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 340 - DNA, 741 bp, Artificial Sequence
  Description of Artificial Sequence: Synthetic polynucleotide
  modified_base (27)..(27): a, c, t, g, unknown or other
  modified_base (78)..(78): a, c, t, g, unknown or other
  modified_base (108)..(108): a, c, t, g, unknown or other
  modified_base (330)..(330): a, c, t, g, unknown or other
  modified_base (430)..(430): a, c, t, g, unknown or other
  modified_base (432)..(432): a, c, t, g, unknown or other
  modified_base (435)..(440): a, c, t, g, unknown or other
  modified_base (445)..(445): a, c, t, g, unknown or other
  modified_base (447)..(448): a, c, t, g, unknown or other
  modified_base (450)..(450): a, c, t, g, unknown or other
  modified_base (456)..(456): a, c, t, g, unknown or other
  modified_base (465)..(465): a, c, t, g, unknown or other
  modified_base (489)..(489): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (573)..(573): a, c, t, g, unknown or other
  modified_base (612)..(612): a, c, t, g, unknown or other
  modified_base (621)..(621): a, c, t, g, unknown or other
  modified_base (645)..(645): a, c, t, g, unknown or other
  modified_base (679)..(681): a, c, t, g, unknown or other
  modified_base (684)..(684): a, c, t, g, unknown or other
  modified_base (702)..(702): a, c, t, g, unknown or other
  modified_base (739)..(741): a, c, t, g, unknown or other
atggcacttcgcacccaatttgaagcnagcaacgatgttggagtcttctgcaaacttaccaatgcctattgtctggtnggcattggttcgtccgagaacttttacagntttgttgaggccgagctggccgacgtcattcccgtcattcactgcaccatttctggcacccgaattgttggacgcgtcacggtgggcaaccggcatggcctgcttgttccaaacgccacaaccgaccaggagttgcagcacattcggaacagtctgccagacacggtccaaattcgacgaatagacgagcggctgtcagcattgggcaatgttgttgcatgnaatgaccatgtggccattgtgcacgccgagatcagcaaggagacggaacaggcgctcgtggaagtgctgaaggttgaggtgtttcggcttagcctgggcnanaannnnnnggtcngnncntacgcngccctcacntccaatggctgtctggtggctgcnaaaactcctccngaagtgcancgcganttggcntcnctcatccaagtgccggtggttgccggaacgatcaatcggggctccganctcatcggggccggtgtttgtgtgaatgattggattgcnttttgcganctggagacaacttccgccgagctntccgtcctcgagtccatcttcaagttgggcgacnnnaangcgccagcagcgattacnaacaatctgcgggacaccctcattgagtccatgcttnnn

SEQ ID NO: 341 - DNA, 927 bp, Artificial Sequence
  Description of Artificial Sequence: Synthetic polynucleotide
  modified_base (1)..(60): a, c, t, g, unknown or other
  modified_base (63)..(63): a, c, t, g, unknown or other
  modified_base (100)..(100): a, c, t, g, unknown or other
  modified_base (117)..(117): a, c, t, g, unknown or other
  modified_base (285)..(285): a, c, t, g, unknown or other
  modified_base (429)..(429): a, c, t, g, unknown or other
  modified_base (431)..(432): a, c, t, g, unknown or other
  modified_base (919)..(927): a, c, t, g, unknown or other
nnnnnnnnnnnnnnnnnnnnnnnnnnnnnnnnnnnnnnnnnnnnnnnnnnnnnnnnnnnnggnatgaagttcaacaaggacaagggccagcacattctcnggaatccgggcattgtnaacgccattgtggagaagtcggccataaaggcgacggacacggtgatggaagttggctctgggacgggcaatttgtcgatgaagcttttggagcgcgccaaccggctgattgccttcgagttggacccgaagatgattgcggagctgcagaagagagtgcttggaacnccagtccaatacaaactgaaggtgctgcccggggatgtgataaaaaaggagtggcccccttttgatgtttgcgtctccaatctgccctacaaaatctcatcgcccttcgtttttcggctgctcctgcagaggccgttgccaagntnngccgtgctgatgttccaaaaggagttcgcggaccgtttgctggccaccccgggcagcaaagtctactgccgcctgtcggtgagcgtccagctgctggccaaggtggagcatttgatgaaggtgcggcgctccgagttcgtgcccccgcccaaggtggactccgccgtggtgcggattgagccgaagaatccgccgcccaaaatcaactacaaggagtgggacggaatgctgcggatggccttcatgcgcaagaaccgcacaatgctgtccatgttcaagctgaaacagaatttggacaccctggagaggaactaccgggttgtttgcaaagcaaagggaaaggaaattcccaaagaattcgccatggccgactacattgagcaggtgctggtggccaacgagttcgccacgaggagggcccggaccatgtccatcgaggacttcctctcactgctgctggccttcaacaaggcggacatccatttcnnnnnnnnn

SEQ ID NO: 342 - DNA, 624 bp, Artificial Sequence
  Description of Artificial Sequence: Synthetic polynucleotide
  modified_base (1)..(24): a, c, t, g, unknown or other
  modified_base (76)..(76): a, c, t, g, unknown or other
  modified_base (78)..(81): a, c, t, g, unknown or other
  modified_base (90)..(90): a, c, t, g, unknown or other
  modified_base (96)..(97): a, c, t, g, unknown or other
  modified_base (111)..(111): a, c, t, g, unknown or other
  modified_base (154)..(156): a, c, t, g, unknown or other
  modified_base (180)..(180): a, c, t, g, unknown or other
  modified_base (201)..(201): a, c, t, g, unknown or other
  modified_base (231)..(231): a, c, t, g, unknown or other
  modified_base (280)..(280): a, c, t, g, unknown or other
  modified_base (306)..(306): a, c, t, g, unknown or other
  modified_base (616)..(624): a, c, t, g, unknown or other
nnnnnnnnnnnnnnnnnnnnnnnnttaccaaatgcgcacttccacaagcattggcagcgccgcatcaagacctggntnnnncaacccgcncgcaannttcgtcgccgccangcgcgcattgccaaggccgctcgggttgcaccgcgccccgtcnnnaacaagcttcgtcccatcgtgcantgccccagcattcgctacaangccaaggttcgactgggccgagggttcacnctggaggagttgaaagccgccggcctgaccaaatacctggccaagtcgntgggcattgcggtcgactatcgccgngtcaatcgttccgtggaatcaatcgagagaaacgcaaagcgcctcaaagagtaccgctcacggctgatcatcttcccgaagaagttgagcaagcccaagaagggagacagcagtccagaagagctgaagatggccgcccaagtcaaaggccccgtgatgccaatccgcatccagcgtcgccgcgagaaggcccagcccgtgaccgatgagctcaagaagttctcggtgtactgccacctgcgccgtgtgcgtgccgacaaacgcttgaagggcaaacgcgacaagaaggctaaggaggcagccgaagagnnnnnnnnn

SEQ ID NO: 343 - DNA, 393 bp, Artificial Sequence
  Description of Artificial Sequence: Synthetic polynucleotide
  modified_base (228)..(228): a, c, t, g, unknown or other
  modified_base (391)..(393): a, c, t, g, unknown or other
atggttcgcatgaatgttcttgccgacgcgctcaagtcgattaataatgccgagaaacgtggaaagagacaggtgattattcggccttcttcgaaagtcataatccgcttcctgacggtcatgatgaagcacggctacattggcgagtttgaaattgtggacgaccatcgtgccggcaagattgtcgtcaacttgactggtcgcattaacaaatgccaagttatcagnccacgtttcgacatccgtatggccgatctcgagaaatggaccagcaatctgcttccgtctcgtcaattcggatacatcgtgctcaccacgtccgccggcatcatggaccacgaagaggctcgaaggaagcacatgggtgggaagattctcggattcttcttcnnn

SEQ ID NO: 344 - DNA, 1626 bp, Artificial Sequence
  Description of Artificial Sequence: Synthetic polynucleotide
  modified_base (1)..(24): a, c, t, g, unknown or other
  modified_base (150)..(150): a, c, t, g, unknown or other
  modified_base (568)..(568): a, c, t, g, unknown or other
  modified_base (570)..(570): a, c, t, g, unknown or other
  modified_base (598)..(598): a, c, t, g, unknown or other
  modified_base (615)..(615): a, c, t, g, unknown or other
  modified_base (651)..(651): a, c, t, g, unknown or other
  modified_base (659)..(659): a, c, t, g, unknown or other
  modified_base (662)..(662): a, c, t, g, unknown or other
  modified_base (676)..(879): a, c, t, g, unknown or other
  modified_base (949)..(951): a, c, t, g, unknown or other
  modified_base (1024)..(1389): a, c, t, g, unknown or other
  modified_base (1618)..(1626): a, c, t, g, unknown or other
nnnnnnnnnnnnnnnnnnnnnnnncgttatgatcgtcagattcggctttggggtgacgaaggacaatcttcaattcagcaagcacgaatttgtgtctttggatcgtcagcgttggcttcagaaatattgaagagcctggtacttgcagcnattggttcattccacataattgatgatgcgcttgtggatgaggcggattttggcaaaaatttctttcttgaagaaaattcactgggcaaatacaaaggcgagtgtctggttcgacaattaacggaattgaatccctctgtttatggtcaacattcgccaattccgctgaagaaattttccaagcatgactttcaaatgttgacgcaattctcactcgtaatcggcacaaatctaactgccaatgaagcaattcgactggacaatttcttattcgagcgcaacatcccgtttgtttacgccagagtttatgggatgttaggccatctgcgcttgtctttcctagaacatatcatttggaacagccacagcgaaaatgatgcatatgatttgagattggattcgccttttccccaattgntnaaaatggcaaaggaaactgatctcactntgatgacccatgaacancactcacatacaccatatttgcttctctatttcaangcaattgncanctggaaagaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcaaatggacgaacaattctggattttatgtgcggcattgcgcgagtttattgccagaaaccagcagnnnatgccactctctggccaactgccggacatgaccagcgattcgaagcgatacattcaactgctcaacatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataactaatccttcaaaggatcccgaattaattgcccgccaaaatgatctcatcccagccgatattatgcaagaagtttgtcgctttggtgctgctgagcctcacgttgttgccgccattttgggtggatgtgtggcccaagaagtgatcaagctgtgtacgcatcaatatgttccggtggacaactcaatcatattcgatggccattcacaacagccgcgtcttttcnnnnnnnnn

SEQ ID NO: 345 - DNA, 3243 bp, Artificial Sequence
  Description of Artificial Sequence: Synthetic polynucleotide
  modified_base (1)..(84): a, c, t, g, unknown or other
  modified_base (207)..(207): a, c, t, g, unknown or other
  modified_base (346)..(381): a, c, t, g, unknown or other
  modified_base (547)..(549): a, c, t, g, unknown or other
  modified_base (835)..(837): a, c, t, g, unknown or other
  modified_base (996)..(996): a, c, t, g, unknown or other
  modified_base (1020)..(1020): a, c, t, g, unknown or other
  modified_base (1041)..(1041): a, c, t, g, unknown or other
  modified_base (1074)..(1074): a, c, t, g, unknown or other
  modified_base (1095)..(1095): a, c, t, g, unknown or other
  modified_base (1317)..(1317): a, c, t, g, unknown or other
  modified_base (1332)..(1332): a, c, t, g, unknown or other
  modified_base (1350)..(1350): a, c, t, g, unknown or other
  modified_base (1353)..(1353): a, c, t, g, unknown or other
  modified_base (1356)..(1356): a, c, t, g, unknown or other
  modified_base (1359)..(1359): a, c, t, g, unknown or other
  modified_base (1598)..(1598): a, c, t, g, unknown or other
  modified_base (1632)..(1632): a, c, t, g, unknown or other
  modified_base (1692)..(1693): a, c, t, g, unknown or other
  modified_base (1735)..(1735): a, c, t, g, unknown or other
  modified_base (1743)..(1743): a, c, t, g, unknown or other
  modified_base (1752)..(1752): a, c, t, g, unknown or other
  modified_base (1755)..(1755): a, c, t, g, unknown or other
  modified_base (1761)..(1761): a, c, t, g, unknown or other
  modified_base (1764)..(1764): a, c, t, g, unknown or other
  modified_base (2061)..(2061): a, c, t, g, unknown or other
  modified_base (2079)..(2079): a, c, t, g, unknown or other
  modified_base (2085)..(2085): a, c, t, g, unknown or other
  modified_base (2097)..(2097): a, c, t, g, unknown or other
  modified_base (2188)..(2190): a, c, t, g, unknown or other
  modified_base (2710)..(2832): a, c, t, g, unknown or other
  modified_base (2854)..(2854): a, c, t, g, unknown or other
  modified_base (2859)..(2859): a, c, t, g, unknown or other
  modified_base (2865)..(2865): a, c, t, g, unknown or other
  modified_base (2919)..(2919): a, c, t, g, unknown or other
  modified_base (2928)..(2928): a, c, t, g, unknown or other
  modified_base (2958)..(2958): a, c, t, g, unknown or other
  modified_base (2976)..(2976): a, c, t, g, unknown or other
  modified_base (2979)..(2979): a, c, t, g, unknown or other
  modified_base (2982)..(2982): a, c, t, g, unknown or other
  modified_base (2988)..(2988): a, c, t, g, unknown or other
  modified_base (2991)..(2991): a, c, t, g, unknown or other
  modified_base (3012)..(3012): a, c, t, g, unknown or other
  modified_base (3015)..(3015): a, c, t, g, unknown or other
  modified_base (3021)..(3021): a, c, t, g, unknown or other
  modified_base (3033)..(3033): a, c, t, g, unknown or other
  modified_base (3061)..(3061): a, c, t, g, unknown or other
  modified_base (3090)..(3090): a, c, t, g, unknown or other
  modified_base (3096)..(3096): a, c, t, g, unknown or other
  modified_base (3103)..(3103): a, c, t, g, unknown or other
  modified_base (3107)..(3107): a, c, t, g, unknown or other
  modified_base (3238)..(3243): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnncagatcgtcactttgatgaatcgctcaacaggcgaagcgcaaaaagccgcctcggatcttctggcacgtttcaaagaaagcccagattcttggacaaaggttgatgccattttggaattttgngacatgctcgagacaaagtacttcggactgcaaatccttgagcagctaatccagacccgctggaaggcgctgccacgcgaccaatgcgaaggcatcaagggctacattgtgaacatgattttggacatcagctcggatnnnnnnnnnnnnnnnnnnnnnnnnnnnnnnnnnnnnaaccttaacatctgcactttgcagattgtcaagcaagaatggccgcgcctttggccttccttcatcagcgacattgttggctccagccgcaatggccagtctctgtgcatgaacaacatggcaatcctgcgtctgctcagcgaggaagttttcgattttggcactnnnggcctcacctccgctcgtgccatccaactcaagcagcagttttgtggccaatttgaggaagtctaccgtctctgccatgaaatcctcgagaattccgacaatgcgcaactcatctatgccacattgagcactctgcatggctttttggactgggtcccggttggatatgtgttcgagaacaatctgatcgaacttatactcaagccagtttcttcccttcccgttttccgctcaatcgcagtccaatgcctagtggaaatctcatccatctccattgacgacaacnnncccggatatggcccaaagctggtgatgctgctgaagacggtcatggaaatcattggtgagcagctgccactctccgtcgacattgccgcttcctacgccaacggcagcaacgacgaccagaagttcgtctccaactttgcgcagctgcttggcaccttnctgaaggagcactccgacctggtngaagtgcttttcctgcatccnactgatgatcagaaggcactcaaacaagcccanttgctggccatgaagtacttnttgaagttgagtcaagtggaggatgtggaagtgttcaagatctgcctcgactactggaattggctttgcatggaactcttccgagaatccccatttgaacagtcctcaatcatcgatgccctgaagcgctacaaccgcgagtcgccacgccggagactttacgcggatgtgctgtcggacttgcgcattctgatgatcagccggatggcaaaaccggaggangtgattgtggttgtnaacgagaacaacgaggcngtncgnganctggtcaaggacaccgactcggtggtgctctacaaaacaatgcgcgagacattggggctattaacccacttggactaccgcgacacggagttgaagatgactgaaaagctgcagaaccaagtgaatggcagtgaatggtcttggaagaatttgaacacgttatgctgggcaattggctcaatcagtggtgccatgcacgaggatgatgagaagcgctttttggtcaccgtgatccgagntttgcttggcctttgcgaacaaaagcgcggcaangacaacaaggcggtgatcgcctccaacatcatgtacgtcgtcggccagtacccgcgcttnntgcgctgccattggaagttcctgaagacggtcatcaacaaantgttcganttcatgcangantcgcanganggcgtccaggacatggcctgcgacacgttcatcaagattgtgatcaaatgcaagctgcactttgtcattatacaagccggtgaatcgcagcccttcattgaggagattctgcagaacttgaacagcatcatctgcgatttgtcgcagccacaagtccatgtcttctatgaggcagtcgggcacatcatttactcggccaccagtcggacaatgcaagagcagctgattgaaaagttgatggtgctgccgaattcaatctggagcgaagccatcgatcatgccagcaaagacgtcacnattctcgcggatcaggangtgctnaagaatttggcncacattttgaagacgaacgtggccgcttgcaagtcaattgggtcgccgtttttcagccagcttaaacgcattctgaacgacatgctgagcnnntaccaagtgatttccagcaatctgaacaaggcagtccatgaggagggcgaacaagtgctgaaattcccgttgatcaagcaaatgcgggttgtgaagaaggaaatcctcactctcttgtccacctggatttcacgcgcgtttgaaggccgcacagtcatcgagaacgtcatccaaccattgttccgcactgtgctgctcgactatgacatgaatgtgccgcaagcgcgtgagccaaaggtgctttcgctgatctccatcaccattgtttcgctaaaggaagacgcatccccgcaagtgccaggaatcctggacgcggtgttcacctgcacgctggacatgatcaacaaggacatggaagcctaccccgagcatcgcaccaacttcttccaactgctcaaagccatcaacacgcattgcttcaacgtggtgattgcgttgccggaccaagtgttgggattgatcatccaagcaattgtttgggccatcaagcacaccatgcggaatgtggcggaaaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattcatttattctacaggtntgacnaatctngccgagaccgtctgccttctcttccaagcggccgaaactctcattgaagtgccnctgaacgcngccaacccggcacagccaaacatggagttngtttatgaggcgattgcntcnctntttgcnaancacttcaagaacctgaccgangcncaaatncgcatcaccgtnaagggcttcttcagctacaacaccaccntgaacaaaatgcgtgaacacatccggganttcctngtgcaanttcnggaagaggcaggcaatgacacggccgatctgttcctggaggagaaggagcaggagatccagcgcatccaaagcgagaagcaggccatccccggagtgcgcaatcccaacgagatgcccgaggaggaaatgnnnnnn

SEQ ID NO: 346 - DNA, 1134 bp, Artificial Sequence
  Description of Artificial Sequence: Synthetic polynucleotide
  modified_base (1)..(357): a, c, t, g, unknown or other
  modified_base (802)..(1134): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaccgaagactgcagtcgccggccatgtacggaaatgcagatgcccctttgaaactgcgcatggaattgaacatggacacagacaaagcgtcaaaattcacgggtgcttctcgccaactcgttcccgtgccttttcccttcaagtacaaagagaagcgcacaattctggcttttgctcccaccaaagaagcacaggatgaggcactcgtgaacggcgctgacttggcacttggcgcggacgctgtgaaaaagattctgaagggcaaattcatcattgatgactacgacttctgcattgcgcaccaggacatggtctcggcaatagcacctctcagaggcatcctgaagacgcgcttcccgaccaaattgaatggcggcattggcacggatttggctgaaattttgaagaatttcttgacggccgtcagcgttgttgtgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 347 - DNA, 2472 bp, Artificial Sequence
  Description of Artificial Sequence: Synthetic polynucleotide
  modified_base (75)..(75): a, c, t, g, unknown or other
  modified_base (118)..(120): a, c, t, g, unknown or other
  modified_base (250)..(1566): a, c, t, g, unknown or other
  modified_base (1720)..(1722): a, c, t, g, unknown or other
  modified_base (1791)..(1791): a, c, t, g, unknown or other
  modified_base (1938)..(1938): a, c, t, g, unknown or other
  modified_base (1978)..(1980): a, c, t, g, unknown or other
  modified_base (2230)..(2472): a, c, t, g, unknown or other
atggattatgtttattacatttacaacaatgtcaaatacttgtacaattccatgaatcccgccactctgtcagtngcaatcgatgtgattgtggttgaacagccggatggacgtcttnnntccacgcctttccatgtccgttttggcaaatatggagtgttcaactacgagaacaagtatgtcgacattgagattaacagtgaggagattgacctgaagatgaagcttggcgaaaatggagtagcattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggctcgaacgatgcgcgcttcagcatcaccacaaaactgcaaggcaccgcctggtgcagttgccacatctacttgatgcgctgggacgacaagttggtcatttccgacattgacggcacaatcaccaagagtgacgtgctgggccatgtgnnncccgccattggaggcacctgggcccattcgggcgttgccgagctgtacacccgcatcaagaacaatggntatcaaatggtctatttgtcatcccgtgccattgggcagtcccactacacaaagacttacctgcaaagcattgcccagggctcgcagactctgcccgatggtcccgtccttctttcgcccacttcagttttgatggccttccgaaangaagtcattgaacgccggccggaagaattcaaaattgccnnntttactgatctgaagtcgctgttccccgacgatcaaccgttctttgcaggctttggaaatcgtgagacggatgtgaagtcctatcaagcggttggcatccccctggaacgcattctgatcattgacccgtcgggaatgctgcgcagagcggacaaaattggcttcgtttcggactatgcgacaatggccatggacacggtggactacatcttcccgccaatcccatttggtgatgctggagctagccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 348 - DNA, 1080 bp, Artificial Sequence
  Description of Artificial Sequence: Synthetic polynucleotide
  modified_base (1)..(81): a, c, t, g, unknown or other
  modified_base (310)..(310): a, c, t, g, unknown or other
  modified_base (373)..(373): a, c, t, g, unknown or other
  modified_base (378)..(378): a, c, t, g, unknown or other
  modified_base (555)..(555): a, c, t, g, unknown or other
  modified_base (579)..(579): a, c, t, g, unknown or other
  modified_base (594)..(594): a, c, t, g, unknown or other
  modified_base (597)..(597): a, c, t, g, unknown or other
  modified_base (600)..(600): a, c, t, g, unknown or other
  modified_base (603)..(603): a, c, t, g, unknown or other
  modified_base (649)..(649): a, c, t, g, unknown or other
  modified_base (675)..(675): a, c, t, g, unknown or other
  modified_base (681)..(681): a, c, t, g, unknown or other
  modified_base (717)..(717): a, c, t, g, unknown or other
  modified_base (720)..(720): a, c, t, g, unknown or other
  modified_base (735)..(735): a, c, t, g, unknown or other
  modified_base (768)..(768): a, c, t, g, unknown or other
  modified_base (772)..(772): a, c, t, g, unknown or other
  modified_base (810)..(810): a, c, t, g, unknown or other
  modified_base (910)..(924): a, c, t, g, unknown or other
  modified_base (1021)..(1080): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnncagaacacggcatgcctggacgactttgaccgtctcaaaacgctgggcactggctctttcgggcgtgtcatgctggtcaagcacaaacagacaggcagcttcttggccatgaagattctggacaagcagaaggtggtcaagctgaagcaggtggagcacacgctcaacgagaagcgaatcctgcaggccatcgacttcccattcctggtcaacatgcaatactcgttcnaggacaactccaacctgtacatggtgctggaattcgtcagcggaggcgaaatgttctcccatntgcgncgcattggccgcttctcggagccccactcgcgcttctatgccgcccagattgtgctggccttcgagtacttgcactcgctggacctcatctacagggacctcaagcccgagaatctgctcattgacaacaatggctacttgaaaatcacagacttcggcttcgccaagcgggtcaanggccggacatggacactgtgtggnacacccgagtatttngcnccnganatcattctcagcaaaggctacaacaaagccgtcgactggtgggcantgggtgtgctgatctacgagatggcngccggntatccgccattctttgccgatcagccaattcaaatntangagaagattgtgtcnggaaaggtcaaattcccgtcgcacttctccaangagntgaaggacctgctgaagaatctgctccaggtggacctnaccaaacgattcggcaatctgaagaacggcgtggccgacatcaaaaaccacaaatggttcggatcggtggactggattgccatctatcagcgaaaggtgnnnnnnnnnnnnnnngcaaaaaacccgacggaaagccgcatcttcgaggcgctctacccaaaaatcacagggcccgacgatacccggcattttgtggagaacgttgatgagnnnnnnnnnnnnnnnnnnnnnnnnnnnnnnnnnnnnnnnnnnnnnnnnnnnnnnnnnnnn

SEQ ID NO: 349 - DNA, 3426 bp, Artificial Sequence
  Description of Artificial Sequence: Synthetic polynucleotide
  modified_base (1)..(9): a, c, t, g, unknown or other
  modified_base (786)..(786): a, c, t, g, unknown or other
  modified_base (805)..(807): a, c, t, g, unknown or other
  modified_base (999)..(999): a, c, t, g, unknown or other
  modified_base (1221)..(1221): a, c, t, g, unknown or other
  modified_base (1428)..(1428): a, c, t, g, unknown or other
  modified_base (1443)..(1443): a, c, t, g, unknown or other
  modified_base (1521)..(1521): a, c, t, g, unknown or other
  modified_base (1527)..(1527): a, c, t, g, unknown or other
  modified_base (1566)..(1566): a, c, t, g, unknown or other
  modified_base (1618)..(2184): a, c, t, g, unknown or other
  modified_base (2277)..(2277): a, c, t, g, unknown or other
  modified_base (2379)..(2379): a, c, t, g, unknown or other
  modified_base (2467)..(2505): a, c, t, g, unknown or other
  modified_base (2686)..(2724): a, c, t, g, unknown or other
  modified_base (2899)..(2958): a, c, t, g, unknown or other
  modified_base (3099)..(3099): a, c, t, g, unknown or other
  modified_base (3253)..(3426): a, c, t, g, unknown or other
nnnnnnnnntctgacgcatcgcaattaaaatttgccgagaagctcgtaattctgaacgatagggctcttggtatgctgacaaggatttacaacatgaaaaaagcatgtgctgatccaaagtctcgaccacagtttctgaatgataaatcattggatcctgcaattgcacatattgtcaagcgtttccctgtgattgatatcaaacgtaattcggccgcctttacatgcgtgaatgaaatgaaaggcgacatattgaagaagctctcactttattattacacatttgtggatttgctcgagctgaaagatgcaattttgcaattatttaccgcaatggatgccaatcagtgcagattgaacattacactgaatttcgacttgacaacaagcttcttaaatttggttgtaaattacatttcagtgatgattttgctttcgcggattgaggatcgcaaagctgtgcttggcttgtttaacgccgcacatgatcttatgcattcaaacagtgaagcttccttcccaagattgggccaaatgataatggactatgaacaaccattgaagaaattggccgaagatttgggactttcttatcggcttatcagctctggcttagaatcactcagggaaatttatttccggcgcaatatttcggcagaacagcagcgggatgcagcgatgatctcattgattgccaatcccaaacagatgctctatgcgacacaaacaaatacgattgcatgcgaatacctctcactggacacaatggaccggtggataattttnggcatttgtctttgccatnnncgtcttctggccgagcagtcccactcttctcttttccaaagggctcttcagcattgcctgaccattcgacttttccgtgatgaatccattctcgttttcccaatgatacaaacagtgctggaaccgcacaaaagttatgggaaattattgtcagaactgaaggaactcaacaccatcactctgcaatcttgnggccatttgcatgcccacaggcgccaattccttcggatggcactaagggaattgtatttgctcatggctgatcagcctggattgctgggcccgaaaatactttttgtttggatggggctatcaatggcacgggatgaggtgctctggctgcttcgccactgcgaccattggccccaattgttgcaaaactcctctgtgaataaaaaggcactccaaaagagnttcctacccgaattgcttttctacatgacggaaatacggaatttggtggtgaaatatgcggaggtgatttcacagtattacattgaatatattaccggctacgactctgttatgttgaccgaattggctcaaagaacaagcgaattgtccgaatatgaatcgttgcttgtgcactcatgtctccaatcgctcgccaatataaaaagnccagtcgattctcgnacaattcgactcgattggtttcgtttccaagcattgaccagtgtggcccgttcctctttcaaattgcaaacccatgcnaatttngccattgccatgaacactgctgtttttcatctgaagcanattgatgatttggatgaaatgttgcgggacacaagcgacttgaatatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaactgattcggaaaacccaaggagaccctccgagatgatggcgtttctgcatgcccaaatgagtggactccaacaattggacacattttcnaatttcgacctgactcgtcttttcaacgatgctctactgcaacaaacacaaagggaagatgcaaatggaagtgaaacattaaccgaaatttactcaaaaggntatttggaagtgctccttcgcaaggctagcaccggtcaactgctctattccgagcatttacaagaatttctcaatagcggaacagacnnnnnnnnnnnnnnnnnnnnnnnnnnnnnnnnnnnnnnngaattacgagcactggcccagttgattggtccgtatgggatcaaacaaattgaggagaagctagtatggcacatagccagtcaaataactgaactcttcaaaattgttcgcgaaaacagagaatcactgcatgttgcgcgcgttaattacgataaaccagcaaaattgagagaggttattnnnnnnnnnnnnnnnnnnnnnnnnnnnnnnnnnnnnnnnggcgccacttctccattggaatcactactccaaagaatcattataattggtgaaatttgcgcctttcgagattctcttttcactgggcttaatgatgtgctcaaacagaggacaccctttctgatgcactcgctttccctgattgactcaaccatggatgaagtgcaaaaaattnnnnnnnnnnnnnnnnnnnnnnnnnnnnnnnnnnnnnnnnnnnnnnnnnnnnnnnnnnnngaggttattcaacgtttaaattaaaatatttttacaattcagcattacaacatttcctgccttctcattgtgtttattgcaattgcattgcctcggctggcaaattatccacaatctttctaccgtgcttcgctggcatgntccaaaaacaattcccatacaatcccgttggcagtaaatacattggccggtgctctcttcttcctccaccaaaggggcgacacagccgatagaatgcgcgaatttcttgcgttggcctcaagtggattgttacaaattgtgggaacaccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 350 - DNA, 1233 bp, Artificial Sequence
  Description of Artificial Sequence: Synthetic polynucleotide
  modified_base (1)..(174): a, c, t, g, unknown or other
  modified_base (330)..(330): a, c, t, g, unknown or other
  modified_base (732)..(732): a, c, t, g, unknown or other
  modified_base (1006)..(1233): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaagaaaacgaaatggctccgttctacgagcaagtttgtgctcatttgaatattcccatcgatgaagctctcatgaagcaactcaaagaaaagaacaaagtgcggcttgacgaaattgataagcaaattgaagatgcggagaagaatctcgcngagagtgaggtgcgccaagcgtggctagcaaagtccgaatatctctgcaaaattggtgacaaaacaaacgcggtctccgcatttcggcagactttcgacaaaactgttggcgttggttatcgcattgacctggtcttcaacctcatccgtattggcctcttcttcatggaccatgaattgatcaccaccaacattgagaaggcaaaggagctgatggaaaagggtggtgattgggaccgcaaaaatcgtcttcgttcctatgaaggtctttacaaaatggccatcagagacatgaagggagcagccgaacttcttctcgaagccgtcccaacatttggtgcctatgaactgatgacttacgaggacctgattttctactcagtcgtcactgccgtcctcgtnctggaccgacccgatttgaaagagaaagttgtgaattgcagcgacattttgcagcagttgaatgccgaaggagagaacaacgcctatttgccgttgaagaatctgatgaacactttcttcgcctgtgactatgaccatttcatgaaggcattggccaaactggagcgagactttctcctcaaggatcgctatctcaaggcccatttccaattctacacgcgcgcaatgcgtgtcaaggcttatcagcaatttctggcgccatacaaatcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 351 - DNA, 2955 bp, Artificial Sequence
  Description of Artificial Sequence: Synthetic polynucleotide
  modified_base (1)..(849): a, c, t, g, unknown or other
  modified_base (962)..(964): a, c, t, g, unknown or other
  modified_base (966)..(968): a, c, t, g, unknown or other
  modified_base (971)..(972): a, c, t, g, unknown or other
  modified_base (975)..(976): a, c, t, g, unknown or other
  modified_base (985)..(987): a, c, t, g, unknown or other
  modified_base (1038)..(1038): a, c, t, g, unknown or other
  modified_base (1074)..(1074): a, c, t, g, unknown or other
  modified_base (1203)..(1203): a, c, t, g, unknown or other
  modified_base (1335)..(1335): a, c, t, g, unknown or other
  modified_base (1392)..(1392): a, c, t, g, unknown or other
  modified_base (1422)..(1422): a, c, t, g, unknown or other
  modified_base (1426)..(1428): a, c, t, g, unknown or other
  modified_base (1440)..(1440): a, c, t, g, unknown or other
  modified_base (1448)..(1450): a, c, t, g, unknown or other
  modified_base (1452)..(1454): a, c, t, g, unknown or other
  modified_base (1459)..(1460): a, c, t, g, unknown or other
  modified_base (1462)..(1463): a, c, t, g, unknown or other
  modified_base (1469)..(1475): a, c, t, g, unknown or other
  modified_base (1479)..(1479): a, c, t, g, unknown or other
  modified_base (1481)..(1482): a, c, t, g, unknown or other
  modified_base (1485)..(1485): a, c, t, g, unknown or other
  modified_base (1531)..(1536): a, c, t, g, unknown or other
  modified_base (1683)..(1683): a, c, t, g, unknown or other
  modified_base (1695)..(1695): a, c, t, g, unknown or other
  modified_base (1698)..(1698): a, c, t, g, unknown or other
  modified_base (1701)..(1701): a, c, t, g, unknown or other
  modified_base (1722)..(1722): a, c, t, g, unknown or other
  modified_base (1725)..(1725): a, c, t, g, unknown or other
  modified_base (1734)..(1734): a, c, t, g, unknown or other
  modified_base (1743)..(1743): a, c, t, g, unknown or other
  modified_base (1767)..(1767): a, c, t, g, unknown or other
  modified_base (1795)..(1795): a, c, t, g, unknown or other
  modified_base (1809)..(1809): a, c, t, g, unknown or other
  modified_base (1968)..(1968): a, c, t, g, unknown or other
  modified_base (2136)..(2136): a, c, t, g, unknown or other
  modified_base (2247)..(2247): a, c, t, g, unknown or other
  modified_base (2425)..(2586): a, c, t, g, unknown or other
  modified_base (2734)..(2835): a, c, t, g, unknown or other
  modified_base (2947)..(2955): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattacagaatgttttcgtgcactttagccggtgttcccgactctgaagaattattgaaaaaatccaggctaccgcttggtctccacatacaacctttcagagacatgagggnnntnnnagnnatnnagacagtcnnnatcactcgctgccgttattgccgaacatacatcaacccatttgtgtttatnatggattcacggcactggaaatgcaacctttgctancgcgcaaatgaccttcccgaagaattttcatgggatccacagacaagaacatttggagatccatcaagaaggcccgaactgcaggaaaccaccattgagtacatagcaccttcggaatacatgcttcgncctccacaacctccaatttactttttcctattcgatgttagctcaagtgcggtcgacaacggatatttgcatacattctctgaacaactcctcgcaaacatcgacaggttgcccggtttcgatcgtgccctngttggctttctcggattcgattccgctctccatttcttccattttgaagaacctggntcagagcccaaacatataatcgagtttganattnnngaaggtttcttnccatttgnnnannnaaaanntnntttttnnnnnnntttncnnccnacaatttacaactttgtgcagcgaataccatccattttcgaacggnnnnnnagttcatcctcatcgaattgtcttggctcggcattggccgttgtaaaagaactcattcaagaaattggaggacgaataactgttttgactgcttcaatgcctaatattggagcgggggcgttgaaaccccgtgaaataacaaaatcntccaaaatcacnttngtnccacagactgactattacaanacnttggcactngaatgcacnggcaaacaaattgccattgacctntttgcaattggctgccgtcaaatggatntgcaaacattggtngacatgtcgaggttcagcagcggcacgatttaccatttccccaactatcatttcctacgagaacaaattgaagtcaaacgattgcaaatggttttgaacagatatttgacaagaaaactgggattggaagccgtgctcagaatacgttgctcaagagtnctttcattgcacactttctatgggaatttcttcattcgttcaacggatttgcttgccctgcccaatgtcagtccggatgcggccatgggagttcaaataaaagcagaaacgctgaccaccagccatgtctgttttcaggctgcccttttgtatacgtccacaaaagtngaccgtcgaattcgtgtgcacactttgagcttgcccgtactcaacaactccacccatgtcttctcctctatggacataaacacgactgtatcgctcctttccaaaatggantcggaaagggcaatgttgggtgccgacatttccgactgtcgcgaagcattgatcaattccgttgtggatggactggccagttaccaacgcatattgggccaggcaagcagcaccatgatgccacccgaaggaggactccaatacatgccaatctatgttcttggattgctaaaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaaccagttatgagcacatttcgcgggagggcatctacttgttggatacaggcagctatgtgtatctctatgtttgttctgctgcacaccccggcacgattggcacattgtttggggtcaattcctttgccaaattggatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggatgacagtccccgtcgtgagttgttcacgggccgattaatccaggacagaacggattcctcgcattcctacgttgaattcatgcagcacatccaacgagaagtgaatnnnnnnnnn

SEQ ID NO: 352 - DNA, 465 bp, Artificial Sequence
  Description of Artificial Sequence: Synthetic polynucleotide
  modified_base (74)..(74): a, c, t, g, unknown or other
  modified_base (76)..(76): a, c, t, g, unknown or other
  modified_base (84)..(84): a, c, t, g, unknown or other
  modified_base (138)..(138): a, c, t, g, unknown or other
  modified_base (234)..(234): a, c, t, g, unknown or other
  modified_base (252)..(252): a, c, t, g, unknown or other
  modified_base (297)..(297): a, c, t, g, unknown or other
  modified_base (300)..(300): a, c, t, g, unknown or other
  modified_base (318)..(318): a, c, t, g, unknown or other
  modified_base (451)..(465): a, c, t, g, unknown or other
atggttttcgatcccaaatccaaagataaagctggcaatttgagctcatatcgggacatgcgtttcgagggttntntggtggancaagaaaaacgattggctcaatccacaacactgtacattggaaatctgtcctanttcacctctgaagagcaggtttgggagttgttccatcgagcaggcgatattcggcgtgtgattatgggcctggacagattccagagaactccatgnggtttttgctttgtcgantattatacgcgcactgatgcggaaaatgcattacgctatataaanggnaccagattggatgaccgngtaattcgttgcgattgggatgcaggtttcaaagaggggagacaatatggacgcggaaagcatggtggtcaggtaaaaaacgagtatcgacagaatttcgatgccggccgtggtggatggaataagacgatcnnnnnnnnnnnnnnn

SEQ ID NO: 353 - DNA, 4086 bp, Artificial Sequence
  Description of Artificial Sequence: Synthetic polynucleotide
  modified_base (1)..(486): a, c, t, g, unknown or other
  modified_base (681)..(681): a, c, t, g, unknown or other
  modified_base (859)..(993): a, c, t, g, unknown or other
  modified_base (1153)..(1383): a, c, t, g, unknown or other
  modified_base (1465)..(1465): a, c, t, g, unknown or other
  modified_base (1472)..(1473): a, c, t, g, unknown or other
  modified_base (1475)..(1475): a, c, t, g, unknown or other
  modified_base (1479)..(1479): a, c, t, g, unknown or other
  modified_base (1482)..(1482): a, c, t, g, unknown or other
  modified_base (1485)..(1485): a, c, t, g, unknown or other
  modified_base (1489)..(1489): a, c, t, g, unknown or other
  modified_base (1491)..(1492): a, c, t, g, unknown or other
  modified_base (1495)..(1495): a, c, t, g, unknown or other
  modified_base (1498)..(1499): a, c, t, g, unknown or other
  modified_base (1501)..(1502): a, c, t, g, unknown or other
  modified_base (1509)..(1510): a, c, t, g, unknown or other
  modified_base (1512)..(1512): a, c, t, g, unknown or other
  modified_base (1516)..(1516): a, c, t, g, unknown or other
  modified_base (1518)..(1518): a, c, t, g, unknown or other
  modified_base (1520)..(1521): a, c, t, g, unknown or other
  modified_base (1528)..(1529): a, c, t, g, unknown or other
  modified_base (1536)..(1536): a, c, t, g, unknown or other
  modified_base (1542)..(1542): a, c, t, g, unknown or other
  modified_base (1544)..(1545): a, c, t, g, unknown or other
  modified_base (1549)..(1549): a, c, t, g, unknown or other
  modified_base (1555)..(1555): a, c, t, g, unknown or other
  modified_base (1557)..(1557): a, c, t, g, unknown or other
  modified_base (1563)..(1564): a, c, t, g, unknown or other
  modified_base (1566)..(1566): a, c, t, g, unknown or other
  modified_base (1568)..(1568): a, c, t, g, unknown or other
  modified_base (1570)..(1571): a, c, t, g, unknown or other
  modified_base (1573)..(1573): a, c, t, g, unknown or other
  modified_base (1576)..(1576): a, c, t, g, unknown or other
  modified_base (1578)..(1583): a, c, t, g, unknown or other
  modified_base (1585)..(1590): a, c, t, g, unknown or other
  modified_base (1593)..(1593): a, c, t, g, unknown or other
  modified_base (1595)..(1596): a, c, t, g, unknown or other
  modified_base (1603)..(1603): a, c, t, g, unknown or other
  modified_base (1608)..(1609): a, c, t, g, unknown or other
  modified_base (1617)..(1618): a, c, t, g, unknown or other
  modified_base (1623)..(1623): a, c, t, g, unknown or other
  modified_base (1626)..(1627): a, c, t, g, unknown or other
  modified_base (1629)..(1630): a, c, t, g, unknown or other
  modified_base (1633)..(1635): a, c, t, g, unknown or other
  modified_base (1638)..(1638): a, c, t, g, unknown or other
  modified_base (1641)..(1644): a, c, t, g, unknown or other
  modified_base (1648)..(1649): a, c, t, g, unknown or other
  modified_base (1653)..(1653): a, c, t, g, unknown or other
  modified_base (1657)..(1662): a, c, t, g, unknown or other
  modified_base (1667)..(1671): a, c, t, g, unknown or other
  modified_base (1673)..(1674): a, c, t, g, unknown or other
  modified_base (1677)..(1678): a, c, t, g, unknown or other
  modified_base (1681)..(1684): a, c, t, g, unknown or other
  modified_base (1687)..(1691): a, c, t, g, unknown or other
  modified_base (1693)..(1696): a, c, t, g, unknown or other
  modified_base (1706)..(1706): a, c, t, g, unknown or other
  modified_base (1708)..(1708): a, c, t, g, unknown or other
  modified_base (1713)..(1713): a, c, t, g, unknown or other
  modified_base (1718)..(1718): a, c, t, g, unknown or other
  modified_base (1721)..(1721): a, c, t, g, unknown or other
  modified_base (1755)..(1755): a, c, t, g, unknown or other
  modified_base (1779)..(1779): a, c, t, g, unknown or other
  modified_base (1783)..(1788): a, c, t, g, unknown or other
  modified_base (1792)..(1792): a, c, t, g, unknown or other
  modified_base (1794)..(1795): a, c, t, g, unknown or other
  modified_base (1806)..(1806): a, c, t, g, unknown or other
  modified_base (1809)..(1809): a, c, t, g, unknown or other
  modified_base (1812)..(1812): a, c, t, g, unknown or other
  modified_base (1814)..(1815): a, c, t, g, unknown or other
  modified_base (1822)..(1824): a, c, t, g, unknown or other
  modified_base (1835)..(1837): a, c, t, g, unknown or other
  modified_base (1842)..(1843): a, c, t, g, unknown or other
  modified_base (1846)..(1846): a, c, t, g, unknown or other
  modified_base (1848)..(1848): a, c, t, g, unknown or other
  modified_base (1852)..(1852): a, c, t, g, unknown or other
  modified_base (1854)..(1854): a, c, t, g, unknown or other
  modified_base (1856)..(1858): a, c, t, g, unknown or other
  modified_base (1860)..(1860): a, c, t, g, unknown or other
  modified_base (1862)..(1862): a, c, t, g, unknown or other
  modified_base (1864)..(1864): a, c, t, g, unknown or other
  modified_base (1866)..(1866): a, c, t, g, unknown or other
  modified_base (1870)..(1870): a, c, t, g, unknown or other
  modified_base (1878)..(1878): a, c, t, g, unknown or other
  modified_base (1881)..(1881): a, c, t, g, unknown or other
  modified_base (1884)..(1884): a, c, t, g, unknown or other
  modified_base (1888)..(1888): a, c, t, g, unknown or other
  modified_base (1890)..(1893): a, c, t, g, unknown or other
  modified_base (1896)..(1896): a, c, t, g, unknown or other
  modified_base (1899)..(1902): a, c, t, g, unknown or other
  modified_base (1904)..(1905): a, c, t, g, unknown or other
  modified_base (1911)..(1914): a, c, t, g, unknown or other
  modified_base (1916)..(1917): a, c, t, g, unknown or other
  modified_base (1919)..(1920): a, c, t, g, unknown or other
  modified_base (1926)..(1926): a, c, t, g, unknown or other
  modified_base (1929)..(1929): a, c, t, g, unknown or other
  modified_base (1932)..(1933): a, c, t, g, unknown or other
  modified_base (1935)..(1942): a, c, t, g, unknown or other
  modified_base (1944)..(1944): a, c, t, g, unknown or other
  modified_base (1947)..(1949): a, c, t, g, unknown or other
  modified_base (1951)..(1956): a, c, t, g, unknown or other
  modified_base (1962)..(1963): a, c, t, g, unknown or other
  modified_base (1965)..(1968): a, c, t, g, unknown or other
  modified_base (1974)..(1974): a, c, t, g, unknown or other
  modified_base (1977)..(1980): a, c, t, g, unknown or other
  modified_base (1982)..(1987): a, c, t, g, unknown or other
  modified_base (1990)..(1991): a, c, t, g, unknown or other
  modified_base (1993)..(1994): a, c, t, g, unknown or other
  modified_base (2004)..(2005): a, c, t, g, unknown or other
  modified_base (2007)..(2007): a, c, t, g, unknown or other
  modified_base (2010)..(2011): a, c, t, g, unknown or other
  modified_base (2019)..(2019): a, c, t, g, unknown or other
  modified_base (2021)..(2021): a, c, t, g, unknown or other
  modified_base (2023)..(2023): a, c, t, g, unknown or other
  modified_base (2025)..(2025): a, c, t, g, unknown or other
  modified_base (2032)..(2032): a, c, t, g, unknown or other
  modified_base (2037)..(2037): a, c, t, g, unknown or other
  modified_base (2040)..(2040): a, c, t, g, unknown or other
  modified_base (2043)..(2043): a, c, t, g, unknown or other
  modified_base (2049)..(2049): a, c, t, g, unknown or other
  modified_base (2052)..(2052): a, c, t, g, unknown or other
  modified_base (2055)..(2055): a, c, t, g, unknown or other
  modified_base (2058)..(2059): a, c, t, g, unknown or other
  modified_base (2061)..(2061): a, c, t, g, unknown or other
  modified_base (2064)..(2064): a, c, t, g, unknown or other
  modified_base (2067)..(2067): a, c, t, g, unknown or other
  modified_base (2070)..(2071): a, c, t, g, unknown or other
  modified_base (2073)..(2074): a, c, t, g, unknown or other
  modified_base (2076)..(2076): a, c, t, g, unknown or other
  modified_base (2080)..(2080): a, c, t, g, unknown or other
  modified_base (2085)..(2086): a, c, t, g, unknown or other
  modified_base (2092)..(2092): a, c, t, g, unknown or other
  modified_base (2095)..(2095): a, c, t, g, unknown or other
  modified_base (2097)..(2097): a, c, t, g, unknown or other
  modified_base (2100)..(2100): a, c, t, g, unknown or other
  modified_base (2107)..(2107): a, c, t, g, unknown or other
  modified_base (2109)..(2109): a, c, t, g, unknown or other
  modified_base (2112)..(2112): a, c, t, g, unknown or other
  modified_base (2118)..(2122): a, c, t, g, unknown or other
  modified_base (2124)..(2124): a, c, t, g, unknown or other
  modified_base (2127)..(2128): a, c, t, g, unknown or other
  modified_base (2130)..(2137): a, c, t, g, unknown or other
  modified_base (2140)..(2140): a, c, t, g, unknown or other
  modified_base (2142)..(2144): a, c, t, g, unknown or other
  modified_base (2146)..(2148): a, c, t, g, unknown or other
  modified_base (2152)..(2152): a, c, t, g, unknown or other
  modified_base (2156)..(2158): a, c, t, g, unknown or other
  modified_base (2163)..(2163): a, c, t, g, unknown or other
  modified_base (2166)..(2166): a, c, t, g, unknown or other
  modified_base (2172)..(2172): a, c, t, g, unknown or other
  modified_base (2175)..(2175): a, c, t, g, unknown or other
  modified_base (2177)..(2177): a, c, t, g, unknown or other
  modified_base (2184)..(2184): a, c, t, g, unknown or other
  modified_base (2190)..(2190): a, c, t, g, unknown or other
  modified_base (2192)..(2193): a, c, t, g, unknown or other
  modified_base (2196)..(2197): a, c, t, g, unknown or other
  modified_base (2200)..(2200): a, c, t, g, unknown or other
  modified_base (2202)..(2202): a, c, t, g, unknown or other
  modified_base (2205)..(2205): a, c, t, g, unknown or other
  modified_base (2208)..(2208): a, c, t, g, unknown or other
  modified_base (2217)..(2217): a, c, t, g, unknown or other
  modified_base (2221)..(2222): a, c, t, g, unknown or other
  modified_base (2224)..(2224): a, c, t, g, unknown or other
  modified_base (2226)..(2226): a, c, t, g, unknown or other
  modified_base (2229)..(2230): a, c, t, g, unknown or other
  modified_base (2238)..(2238): a, c, t, g, unknown or other
  modified_base (2241)..(2241): a, c, t, g, unknown or other
  modified_base (2244)..(2244): a, c, t, g, unknown or other
  modified_base (2247)..(2247): a, c, t, g, unknown or other
  modified_base (2250)..(2251): a, c, t, g, unknown or other
  modified_base (2253)..(2253): a, c, t, g, unknown or other
  modified_base (2256)..(2256): a, c, t, g, unknown or other
  modified_base (2259)..(2259): a, c, t, g, unknown or other
  modified_base (2380)..(2574): a, c, t, g, unknown or other
  modified_base (2590)..(2590): a, c, t, g, unknown or other
  modified_base (2592)..(2593): a, c, t, g, unknown or other
  modified_base (2596)..(2602): a, c, t, g, unknown or other
  modified_base (2604)..(2604): a, c, t, g, unknown or other
  modified_base (2606)..(2606): a, c, t, g, unknown or other
  modified_base (2608)..(2608): a, c, t, g, unknown or other
  modified_base (2610)..(2610): a, c, t, g, unknown or other
  modified_base (2614)..(2614): a, c, t, g, unknown or other
  modified_base (2616)..(2616): a, c, t, g, unknown or other
  modified_base (2619)..(2619): a, c, t, g, unknown or other
  modified_base (2623)..(2624): a, c, t, g, unknown or other
  modified_base (2626)..(2627): a, c, t, g, unknown or other
  modified_base (2632)..(2632): a, c, t, g, unknown or other
  modified_base (2634)..(2637): a, c, t, g, unknown or other
  modified_base (2639)..(2640): a, c, t, g, unknown or other
  modified_base (2646)..(2646): a, c, t, g, unknown or other
  modified_base (2652)..(2652): a, c, t, g, unknown or other
  modified_base (2655)..(2655): a, c, t, g, unknown or other
  modified_base (2659)..(2659): a, c, t, g, unknown or other
  modified_base (2661)..(2664): a, c, t, g, unknown or other
  modified_base (2670)..(2671): a, c, t, g, unknown or other
  modified_base (2679)..(2680): a, c, t, g, unknown or other
  modified_base (2682)..(2683): a, c, t, g, unknown or other
  modified_base (2685)..(2685): a, c, t, g, unknown or other
  modified_base (2688)..(2688): a, c, t, g, unknown or other
  modified_base (2694)..(2694): a, c, t, g, unknown or other
  modified_base (2707)..(2707): a, c, t, g, unknown or other
  modified_base (2709)..(2709): a, c, t, g, unknown or other
  modified_base (2712)..(2712): a, c, t, g, unknown or other
  modified_base (2715)..(2718): a, c, t, g, unknown or other
  modified_base (2720)..(2721): a, c, t, g, unknown or other
  modified_base (2725)..(2727): a, c, t, g, unknown or other
  modified_base (2730)..(2730): a, c, t, g, unknown or other
  modified_base (2733)..(2733): a, c, t, g, unknown or other
  modified_base (2740)..(2741): a, c, t, g, unknown or other
  modified_base (2745)..(2746): a, c, t, g, unknown or other
  modified_base (2748)..(2754): a, c, t, g, unknown or other
  modified_base (2757)..(2762): a, c, t, g, unknown or other
  modified_base (2764)..(2764): a, c, t, g, unknown or other
  modified_base (2766)..(2766): a, c, t, g, unknown or other
  modified_base (2769)..(2769): a, c, t, g, unknown or other
  modified_base (2771)..(2772): a, c, t, g, unknown or other
  modified_base (2775)..(2778): a, c, t, g, unknown or other
  modified_base (2781)..(2781): a, c, t, g, unknown or other
  modified_base (2785)..(2785): a, c, t, g, unknown or other
  modified_base (2787)..(2787): a, c, t, g, unknown or other
  modified_base (2790)..(2791): a, c, t, g, unknown or other
  modified_base (2793)..(2793): a, c, t, g, unknown or other
  modified_base (2796)..(2800): a, c, t, g, unknown or other
  modified_base (2802)..(2802): a, c, t, g, unknown or other
  modified_base (2806)..(2808): a, c, t, g, unknown or other
  modified_base (2811)..(2811): a, c, t, g, unknown or other
  modified_base (2814)..(2814): a, c, t, g, unknown or other
  modified_base (2818)..(2820): a, c, t, g, unknown or other
  modified_base (2856)..(2856): a, c, t, g, unknown or other
  modified_base (2968)..(2976): a, c, t, g, unknown or other
  modified_base (3058)..(3067): a, c, t, g, unknown or other
  modified_base (3070)..(3071): a, c, t, g, unknown or other
  modified_base (3075)..(3077): a, c, t, g, unknown or other
  modified_base (3080)..(3085): a, c, t, g, unknown or other
  modified_base (3087)..(3087): a, c, t, g, unknown or other
  modified_base (3091)..(3091): a, c, t, g, unknown or other
  modified_base (3093)..(3093): a, c, t, g, unknown or other
  modified_base (3102)..(3102): a, c, t, g, unknown or other
  modified_base (3108)..(3108): a, c, t, g, unknown or other
  modified_base (3112)..(3112): a, c, t, g, unknown or other
  modified_base (3114)..(3117): a, c, t, g, unknown or other
  modified_base (3119)..(3120): a, c, t, g, unknown or other
  modified_base (3124)..(3125): a, c, t, g, unknown or other
  modified_base (3127)..(3127): a, c, t, g, unknown or other
  modified_base (3129)..(3130): a, c, t, g, unknown or other
  modified_base (3132)..(3132): a, c, t, g, unknown or other
  modified_base (3135)..(3135): a, c, t, g, unknown or other
  modified_base (3142)..(3142): a, c, t, g, unknown or other
  modified_base (3144)..(3144): a, c, t, g, unknown or other
  modified_base (3165)..(3165): a, c, t, g, unknown or other
  modified_base (3176)..(3176): a, c, t, g, unknown or other
  modified_base (3315)..(3315): a, c, t, g, unknown or other
  modified_base (3330)..(3330): a, c, t, g, unknown or other
  modified_base (3336)..(3336): a, c, t, g, unknown or other
  modified_base (3348)..(3348): a, c, t, g, unknown or other
  modified_base (3357)..(3357): a, c, t, g, unknown or other
  modified_base (3360)..(3360): a, c, t, g, unknown or other
  modified_base (3363)..(3363): a, c, t, g, unknown or other
  modified_base (3402)..(3402): a, c, t, g, unknown or other
  modified_base (3418)..(3418): a, c, t, g, unknown or other
  modified_base (3423)..(3423): a, c, t, g, unknown or other
  modified_base (3428)..(3429): a, c, t, g, unknown or other
  modified_base (3431)..(3434): a, c, t, g, unknown or other
  modified_base (3439)..(3445): a, c, t, g, unknown or other
  modified_base (3448)..(3448): a, c, t, g, unknown or other
  modified_base (3464)..(3464): a, c, t, g, unknown or other
  modified_base (3480)..(3480): a, c, t, g, unknown or other
  modified_base (3522)..(3522): a, c, t, g, unknown or other
  modified_base (3525)..(3525): a, c, t, g, unknown or other
  modified_base (3534)..(3534): a, c, t, g, unknown or other
  modified_base (3546)..(3547): a, c, t, g, unknown or other
  modified_base (3582)..(3582): a, c, t, g, unknown or other
  modified_base (3594)..(3594): a, c, t, g, unknown or other
  modified_base (3603)..(3603): a, c, t, g, unknown or other
  modified_base (3609)..(3609): a, c, t, g, unknown or other
  modified_base (3636)..(3636): a, c, t, g, unknown or other
  modified_base (3642)..(3643): a, c, t, g, unknown or other
  modified_base (3648)..(3648): a, c, t, g, unknown or other
  modified_base (3651)..(3652): a, c, t, g, unknown or other
  modified_base (3669)..(3669): a, c, t, g, unknown or other
  modified_base (3705)..(3705): a, c, t, g, unknown or other
  modified_base (3762)..(3762): a, c, t, g, unknown or other
  modified_base (3832)..(4086): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcaatcacaacaaatgctgcccaaagtcctgttgctgaactaccggttgagacaacatttggtggaggttttcaggtcattatccaaacaccggaagagcaaaattcgaatattttgacaagagaaggactgctcagacatgttgacattctggaacaaattgccaactacagcatccaaatgtttggggantcctggtatttgtcggacatttgcttcaagccaccaccgccggcaacttccaaggatgtgctggcccaaatcatggaggacattgttgcccaaatcattccctgtgtttggatcactccaatcgattgcttctgggaaggttccaaaccactcggtccattccccccgttggatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggcattggagcagcatatcaagaccgctattgtatagacccattggacccggattgcccaaaaacgtcgccaaattacttcgatcgctgtcgagcttatcaaaggtttttggaatggaacaaaggattgcctgaagacaagcaaatccacttggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgacaaatatggtcgaagcttcatggaatgggtgaacaacaatcgtgacaaacttacgcaatttctaccggaggaaatgntgccaanntntccnaantangggnanntgntgnngnntggctgnnanggantngnnaaaaatnngatgaantggccngnngacntgattntnggcggnntnananngnacnannnnnntnnnnnncangnngaagcanttcanncggttttnntggtngcnncnnccnnngangtnnnnagannattnaagnnnnnnaaatnnnnntnnaanncannnnttnnnnnannnnatttttcccnantcccngccancgncctcattcatgcatggcaaaggaattttaccaancgcatttacgagcatcctttgaanaaannnnnncggntnntccatccgctngcntcnanntcaattnnngacatgctggnnnagttnngcnanttcnantnnntnancntnttcnttggctangtnctnatgntnnnntangcnnnntnntcccannnncnntnngatggntgntgnntnnnnnnnnantcnnntnnnnnncttgcnntnnnnggagtnctnnnngnnnnnntgnntnntgttgccggnntnggnntttccacntncntnggaatcnacttnaangcngcaacnacncanatnntnccnttnctnncnntngganttggnnttgacnacntnttnttgctgntncanaattannnnnangtnntnnnnnnnntcnannnannngaanttgnnnttttnctnaagganacngnaatgtcnattttnannacnnctntnaanaanattctcgcntttnngncnggnncaattttnccnatnccngcnntncgntcnttttgtggacagacggcaattcttctgacagcaaatcttgttggaatatttcttgcttaccctgcctttattgcactcgatttgaagcgtcgaaaggcaggccgaagggatatggcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcaggcgacaattntnntgnnnnnnntngncntnttcntnttnggtnntnntggcntnnnncnntcaaanattggnctngaantnnnngatgtnntgcctgannanncngcnccagcngctttcctgaaancncgngannnntnnttcnnnttntanccaatgnncatnntnnnnnnnggnnnnnncntngantnnccnnnncancaanancanntngannnnntncggnnnganatnggtnnnacaaaaattaagataattttacccaaaaaatttagncactattggctgcaactgtttcgggaatggctacgtggaatgcaacagcggctggacgaagcaaagcgcaatggctggcttgaggattttgattccccaaattcaactgtgnnnnnnnnnccaaaaagccccgaccttcaaattgcctattcattggcgtgttcttatggagaaaactacgattgtgcaagagcggagcaannnnnnnnnntgnntgannntgnnnnnntnaatncngaaggcttntacaantatntnnnngnntggnncnannanganaatatgntntattatgtctcccaagcggcnttcttcccaanaccgccgccctggcattatttgcaaactgatgaaactgttataccgccggctgatcctttgatctattcacaagtgcctttttacatgaatggactcacagacacgcaagccattgtgcaaatgataaaagagatccgnggcatttgtgaccgntacgcngaacaaggtctnccaacattnccnacnggcattccattcactttttgggagcagtatttgcaactnaccttctatttgttcncatcnatttnnannnnttttnnnnnnnaantttatatcatccaacnatttaagttcaacccntgggcggcagcaatggtggccataattgtggtgacaatgacngtngaattggcnggctttatgggnntgtttggcgtgaagatgaatccaatatccgcggtnactttgattacngcggttggnataggngtggaattcacagcccatgttgtgctngccttnntaacntcnntggggagcagagatgancggatggtttcttgcttggagcacatgttcatcccngtcatccatggtggcctttcaacactgcttggcatcatcatgttggcattttcagantttgattttgttgtcaagtatttctttgttgttatgactgctctcatcataattgggctgatcaatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 354 - DNA, 1314 bp, Artificial Sequence
  Description of Artificial Sequence: Synthetic polynucleotide
  modified_base (78)..(78): a, c, t, g, unknown or other
  modified_base (138)..(138): a, c, t, g, unknown or other
  modified_base (159)..(159): a, c, t, g, unknown or other
  modified_base (162)..(162): a, c, t, g, unknown or other
  modified_base (171)..(171): a, c, t, g, unknown or other
  modified_base (183)..(183): a, c, t, g, unknown or other
  modified_base (186)..(186): a, c, t, g, unknown or other
  modified_base (204)..(204): a, c, t, g, unknown or other
  modified_base (216)..(216): a, c, t, g, unknown or other
  modified_base (219)..(219): a, c, t, g, unknown or other
  modified_base (239)..(240): a, c, t, g, unknown or other
  modified_base (242)..(243): a, c, t, g, unknown or other
  modified_base (246)..(246): a, c, t, g, unknown or other
  modified_base (282)..(282): a, c, t, g, unknown or other
  modified_base (356)..(357): a, c, t, g, unknown or other
  modified_base (462)..(463): a, c, t, g, unknown or other
  modified_base (466)..(466): a, c, t, g, unknown or other
  modified_base (468)..(470): a, c, t, g, unknown or other
  modified_base (474)..(474): a, c, t, g, unknown or other
  modified_base (544)..(546): a, c, t, g, unknown or other
  modified_base (693)..(693): a, c, t, g, unknown or other
  modified_base (789)..(789): a, c, t, g, unknown or other
  modified_base (801)..(801): a, c, t, g, unknown or other
  modified_base (805)..(806): a, c, t, g, unknown or other
  modified_base (825)..(825): a, c, t, g, unknown or other
  modified_base (852)..(852): a, c, t, g, unknown or other
  modified_base (879)..(879): a, c, t, g, unknown or other
  modified_base (891)..(891): a, c, t, g, unknown or other
  modified_base (894)..(894): a, c, t, g, unknown or other
  modified_base (930)..(930): a, c, t, g, unknown or other
  modified_base (954)..(954): a, c, t, g, unknown or other
  modified_base (961)..(961): a, c, t, g, unknown or other
  modified_base (987)..(987): a, c, t, g, unknown or other
  modified_base (1014)..(1014): a, c, t, g, unknown or other
  modified_base (1017)..(1017): a, c, t, g, unknown or other
  modified_base (1020)..(1021): a, c, t, g, unknown or other
  modified_base (1052)..(1052): a, c, t, g, unknown or other
  modified_base (1055)..(1055): a, c, t, g, unknown or other
  modified_base (1091)..(1091): a, c, t, g, unknown or other
  modified_base (1099)..(1314): a, c, t, g, unknown or other
atgctcgttgtcatcatccacccggagcaatggaatggcggctccgaccggtgcaccatcggcctccttcggcacttngtcggcgccggccatcaggtcgtatggctgaccaccatgattgacgactactgggcaggngaggagttccagggcgtaacnatncgcgagatncgcctcccactncancccggcgactggttctcncagaacattgcnctngcctaccacctcatcctgannannctncagccggacctggtggttgttgaccacagtgcgtcntgcgtgccgctgctgaagtggtactacccaaagtgccgcatcctcttctactgccatttcccacagcaattggnnatgcccgaccgcttcttcgtctatcgctggtactcctggctgatgggcatcatcgagggccgactgtttgagtatgccgacctgatcatggtgaacagcgagttnncangnnnacanttccaagcagtgatgccaactgtgcccaagagtcacttgcgcgtggtgtacccgccctgtgatgtggacnnntcgctgagcgtggcttgcaagccgatttcacgcaaacaacgaccacccaatgaacgctacctcttcctctccatgaaccgcttttggcccgagaagcggctggacatcatcctcgacgcgactggtattctgaagcgccttggcctntccccactcatccaaatggccggctccgtgatgccgcacattcccgagtcgcgaatctactttgagctgttgaaaaaacgctgcaaacagctccgncttgatgacatnattnngtttgtgcccgacccaaangatgagcgcaaattccagctgtatcgncaatgcgactcggtgatctacacgccncccaacgaacanttnggcattgtgcccatcgaggcgttggagcagcgtcgnccggtgattgtgattgacagtggnggaccgncggaaaccgtcatcgagggagtcacnggcaccaagatttcggacacggaaggnatnctnntggccgaagcaatggccgagcacatggccanggnggagtgggaggaactggactcggatcagcactatgngggacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 355 - DNA, 1710 bp, Artificial Sequence
  Description of Artificial Sequence: Synthetic polynucleotide
  modified_base (1)..(249): a, c, t, g, unknown or other
  modified_base (541)..(543): a, c, t, g, unknown or other
  modified_base (654)..(654): a, c, t, g, unknown or other
  modified_base (678)..(678): a, c, t, g, unknown or other
  modified_base (696)..(696): a, c, t, g, unknown or other
  modified_base (822)..(822): a, c, t, g, unknown or other
  modified_base (882)..(882): a, c, t, g, unknown or other
  modified_base (888)..(888): a, c, t, g, unknown or other
  modified_base (894)..(894): a, c, t, g, unknown or other
  modified_base (901)..(901): a, c, t, g, unknown or other
  modified_base (903)..(903): a, c, t, g, unknown or other
  modified_base (1102)..(1113): a, c, t, g, unknown or other
  modified_base (1210)..(1260): a, c, t, g, unknown or other
  modified_base (1359)..(1359): a, c, t, g, unknown or other
  modified_base (1435)..(1710): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaaacgcaaacaaacaaataagaaacaatgggaacaccagcgaagcatggcaaaaagcggaaatcgaccaagaatgcgcccacatcgtcccgaaaatgtacggttttttacttaaattacaaaaaatttcataaattttaagctcgcaaactggtattcgagcctctgtccatagagcactacagacccaaagaggcgggcactcgggtgctcagctgcggtgagggcgaacagcttggacatccgggccggaacaccaccagaaagcctcgtgccatcgacacctttnnnccggagggcaccaaatttcttcaggtcgctgctggcggtgttcactcacttgtgctcaccgaggacagcactgtgtacagttgtggaatcaacgagaagggcacggtgccngtgcaaggcttggaggccgagggnagcaccgaccggttcagngagattgtgtttgcgccagacatcaagcagttgggcaagattgttcaaatcacggccggtgccagtttctcggcggcactcacggagaagggctctgtcattgcgtggggaaatcttcgggacacncaaggcgaagtgaatgtccatgagacgctgaaagacatccagaagaagccggtcgtcgtnatacgncacaancagaagnanaattcacagatcgccgccggtgaaaaccacctggccatgctgtccaacgagggcgagctgctcacattcggcgaaggctccatgggccaactgggccgctcagttcgcaccgaacacatccgctccaagttcatggttgaccagtccggcaatttcctcattgtgcgcgtgctggagaagcaccaatttgtgcgctttnnnnnnnnnnnngtggacgtctgggcacgcggcttttggaccattggacggacgcaggatggacgactgtttgcctgtggactgaacaattttggccaactgggcgtgnnnnnnnnnnnnnnnnnnnnnnnnnnnnnnnnnnnnnnnnnnnnnnnnnnnaaagttgcactgctgacctgggctcaagcctttccggccgacaaggtgtggacccatgcgtcgggcgttcagcatattgtttgtcgcactgaagaagtngagctttttggcatcggcaagaacacggacaacgcgttgggcattggcacttgggagggcaatcaagacgaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 356 - DNA, 615 bp, Artificial Sequence
  Description of Artificial Sequence: Synthetic polynucleotide
  modified_base (1)..(21): a, c, t, g, unknown or other
  modified_base (340)..(441): a, c, t, g, unknown or other
  modified_base (613)..(615): a, c, t, g, unknown or other
nnnnnnnnnnnnnnnnnnnnnggcggcactgttatcgcaatgaagagcagagatgcagtttgtgttgctacggacatgcgtcttggagaccaaagaaacaacattgcgactaatgtctccaaggtccatcgcattgatgacaaactgttcgtcggcttatgcggatttagttgtgacactgctactgttctggacaagcttaagctccataaagatctttacgaacttcgcgaggatcgtccaatgcgaccgaaaatattttccaactatctctcaacattgctctacaaacgtcgcttcgggccatatttcgtcatgccacttgttgctggtattgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatctttaggtttttggcgtccagacctcaaaaccgagcaattgaccgaagcttgtgcccagactatgatgggaatcattgagcgtgacgcttctaccggatggggagcaattgtttacacaatcaccaaggatggcgttcattctcgagctctgaaatgccgcatggatnnn

SEQ ID NO: 357 - DNA, 3132 bp, Artificial Sequence
  Description of Artificial Sequence: Synthetic polynucleotide
  modified_base (202)..(273): a, c, t, g, unknown or other
  modified_base (372)..(372): a, c, t, g, unknown or other
  modified_base (671)..(676): a, c, t, g, unknown or other
  modified_base (678)..(678): a, c, t, g, unknown or other
  modified_base (681)..(681): a, c, t, g, unknown or other
  modified_base (1206)..(1206): a, c, t, g, unknown or other
  modified_base (1468)..(1470): a, c, t, g, unknown or other
  modified_base (1500)..(1500): a, c, t, g, unknown or other
  modified_base (1744)..(1812): a, c, t, g, unknown or other
  modified_base (1890)..(1890): a, c, t, g, unknown or other
  modified_base (2242)..(2433): a, c, t, g, unknown or other
  modified_base (2722)..(3132): a, c, t, g, unknown or other
atgcgtataaaaattgacaatcgcattcggacgctggtggaaaatggaatgattacccggcatcgttcaatgttcatcattattggggacaaagcacgggatcaagtggtcaccctgcaccatattttaaccaaagctggaatttcagcgagaccctcggttttatggtgttacaaaaaggagttggacatcagttcacacnnnnnnnnnnnnnnnnnnnnnnnnnnnnnnnnnnnnnnnnnnnnnnnnnnnnnnnnnnnnnnnnnnnnnnnnttcgagcagttcatcctggccacacacatccgctattgttactacgccgaatcccatcgcattttgggcaacacctttggcatggctgtacttcaagtnttcgaagcattaacccccaatttacttgctcgaaccattgaaactgttgagggtggcggattgattgttttgctgctgcaaagcgtgcactccttgaagcagttgtacacaatgaccatggatatacacaaacgctatcggacagaagcgcattccgatgtggttggacgttttaatgaacgttttattctttcgctggccacttgcccgacttgtgtgctcatggatgattgcctcaatgtattgcccatttcttcggccatctcaaaaatcacgccaattcctgcaaatcaaaaagnnnnnnantcngaagcccaattggaattgcaaaaacttcaacgctctttagccgacacaaaacccattggcccactgctgaacaaatgtgccacactgtgccaagcaaaagtgcttctccgcttgttggacgcagccaccgaaaagatgcagaacacaacttgctcaatcacggccgcccgcggtcgcggcaagtcggcagcaatgggcttggctgtggcgggcgccattggctttggctttaccaacattgtggtgaccagcccgagtgtggagaatttgcgcacgctttttgagtttgtggtcaagggattcgaggcgatcggatatcaggaacacgccgactatgaacttgtcaagtccatggacccagtgctggacaaatgtgtgacgcgcgtgaatgtgttcaggaaacacaggcaaactatccagtacattgaaccaaccgacgcagtcaaactgttgcaagccgaactggtggttgttgatgaggcggcggcaattcccattccaattgtgaagaagttgattacagancctttcctggtgtttctcgcctcaacaataagcggttacgagggcaccggccgatcattgtccctgaaattgttggaacaattgaggcagcaacaatccagttcaacaggcgaagaagggaagaaagttggccaacagagaagaacgttgtatgagcttacactggaggagagcattcgctatggggacaatgacccggttgaggactggctgaaccgtgtgctctgcttgaatccagtgaatttgaatggaactatttcannnggcaccccggcacccgaaaaatgccaactntgccgaggttttcaatattttttattttaatttacttttgtttttttgattttcctctccaatttgatgtccatctatgtggctgctcactacaagaacagtccggatgatttgcagctgctttcggatgcgccggcccatcaaatatttgtcctgatgccgccggtttcgaagaagacaaaatcaatccctcaaattctggccgttcttcaaatctgctttgaaggtaaatatgaggaaaatnnnnnnnnnnnnnnnnnnnnnnnnnnnnnnnnnnnnnnnnnnnnnnnnnnnnnnnnnnnnnnnnnnnnnaatttttaggattccgatttcccccaactttgcggcgctcggatagttcggattgcagtgcatcctgattttcaagcnatgggctatggctctcgtgcaatccaactggtccagcaatattatcaaggaaaattcagtacatttgagccaacaaattcaactgaaaacgatgaagcaaatgcagatgagtccatggaagtcattgatgaggattgtcaactgcttcaagaggaaattacacctcgtgcaaatttgcctccccttttgcaacgtttggccgaaagaccggccgaacgcctcgactacatgggcgcttgttttggccttaccctgccacttttgaagttctggaaacggcttggatttctgcctgttcatttacgccaaagcgcaaacagcttaactggagagcatagttgcattcttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctcagccgcgttgaacttcgctgggtgctgtcggatttggatctccgccgattggcgcattacgcgaagaatttggcggaccagcagttgataaccgatttgctgcctgcccttggctcactctatttccagggacggcttggaccggatgcacagcttgaacttggccaagctgccgtccttttaggagttggcctacagcgaaagtcggttgaggaaattgcccgccaattggaattgccttccaaccaatgccatgccctcctcaacaaagctgttcgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 358 - DNA, 885 bp, Artificial Sequence
  Description of Artificial Sequence: Synthetic polynucleotide
  modified_base (1)..(147): a, c, t, g, unknown or other
  modified_base (280)..(552): a, c, t, g, unknown or other
  modified_base (685)..(687): a, c, t, g, unknown or other
  modified_base (880)..(885): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaggtgaccaattgttatgctatcccattccgtgagtcgaatgacactcccgaaataaacgatagcatcaatcgctccatgctaatgatatcgaaaaaatcatcaccaactgaacagattgttggatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataatttagaagggaattgactcggaacgccgtgaagttgaatttggggacggcgaaaatcaactgttgaagaacacagaggaattgatggaatggctgatggcggcatctggctatgtgaagaacgtannnctctcgggcaaggaaattgcagaccccgcgattggtcggcgactcatggagatcgtcacatttgccaacacgcaattgccggccaacaaattggagaacttggccaagcactctctccgcgattatctgatggtttctctgctggcaaatttggcaaagacgcaactggcactacaagagaaaattacatccnnnnnn

SEQ ID NO: 359 - DNA, 14262 bp, Artificial Sequence
  Description of Artificial Sequence: Synthetic polynucleotide
  modified_base (1)..(126): a, c, t, g, unknown or other
  modified_base (163)..(163): a, c, t, g, unknown or other
  modified_base (187)..(187): a, c, t, g, unknown or other
  modified_base (207)..(207): a, c, t, g, unknown or other
  modified_base (265)..(265): a, c, t, g, unknown or other
  modified_base (271)..(271): a, c, t, g, unknown or other
  modified_base (305)..(305): a, c, t, g, unknown or other
  modified_base (307)..(307): a, c, t, g, unknown or other
  modified_base (315)..(317): a, c, t, g, unknown or other
  modified_base (320)..(320): a, c, t, g, unknown or other
  modified_base (334)..(334): a, c, t, g, unknown or other
  modified_base (336)..(336): a, c, t, g, unknown or other
  modified_base (338)..(338): a, c, t, g, unknown or other
  modified_base (400)..(401): a, c, t, g, unknown or other
  modified_base (404)..(404): a, c, t, g, unknown or other
  modified_base (414)..(414): a, c, t, g, unknown or other
  modified_base (419)..(419): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (465)..(465): a, c, t, g, unknown or other
  modified_base (484)..(484): a, c, t, g, unknown or other
  modified_base (496)..(496): a, c, t, g, unknown or other
  modified_base (498)..(498): a, c, t, g, unknown or other
  modified_base (519)..(520): a, c, t, g, unknown or other
  modified_base (526)..(526): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (553)..(553): a, c, t, g, unknown or other
  modified_base (567)..(567): a, c, t, g, unknown or other
  modified_base (582)..(582): a, c, t, g, unknown or other
  modified_base (597)..(597): a, c, t, g, unknown or other
  modified_base (602)..(602): a, c, t, g, unknown or other
  modified_base (633)..(635): a, c, t, g, unknown or other
  modified_base (648)..(648): a, c, t, g, unknown or other
  modified_base (654)..(654): a, c, t, g, unknown or other
  modified_base (657)..(657): a, c, t, g, unknown or other
  modified_base (660)..(660): a, c, t, g, unknown or other
  modified_base (662)..(662): a, c, t, g, unknown or other
  modified_base (664)..(664): a, c, t, g, unknown or other
  modified_base (670)..(670): a, c, t, g, unknown or other
  modified_base (675)..(675): a, c, t, g, unknown or other
  modified_base (716)..(716): a, c, t, g, unknown or other
  modified_base (719)..(719): a, c, t, g, unknown or other
  modified_base (741)..(741): a, c, t, g, unknown or other
  modified_base (744)..(744): a, c, t, g, unknown or other
  modified_base (747)..(747): a, c, t, g, unknown or other
  modified_base (772)..(772): a, c, t, g, unknown or other
  modified_base (774)..(774): a, c, t, g, unknown or other
  modified_base (778)..(778): a, c, t, g, unknown or other
  modified_base (783)..(783): a, c, t, g, unknown or other
  modified_base (796)..(796): a, c, t, g, unknown or other
  modified_base (803)..(803): a, c, t, g, unknown or other
  modified_base (814)..(815): a, c, t, g, unknown or other
  modified_base (840)..(840): a, c, t, g, unknown or other
  modified_base (856)..(856): a, c, t, g, unknown or other
  modified_base (874)..(874): a, c, t, g, unknown or other
  modified_base (883)..(883): a, c, t, g, unknown or other
  modified_base (990)..(990): a, c, t, g, unknown or other
  modified_base (999)..(999): a, c, t, g, unknown or other
  modified_base (1020)..(1020): a, c, t, g, unknown or other
  modified_base (1105)..(1128): a, c, t, g, unknown or other
  modified_base (1189)..(1191): a, c, t, g, unknown or other
  modified_base (1204)..(1209): a, c, t, g, unknown or other
  modified_base (1212)..(1218): a, c, t, g, unknown or other
  modified_base (1299)..(1299): a, c, t, g, unknown or other
  modified_base (1426)..(1426): a, c, t, g, unknown or other
  modified_base (1428)..(1428): a, c, t, g, unknown or other
  modified_base (1431)..(1431): a, c, t, g, unknown or other
  modified_base (1441)..(1441): a, c, t, g, unknown or other
  modified_base (1444)..(1445): a, c, t, g, unknown or other
  modified_base (1449)..(1449): a, c, t, g, unknown or other
  modified_base (1452)..(1452): a, c, t, g, unknown or other
  modified_base (1488)..(1488): a, c, t, g, unknown or other
  modified_base (1506)..(1506): a, c, t, g, unknown or other
  modified_base (1510)..(1510): a, c, t, g, unknown or other
  modified_base (1527)..(1527): a, c, t, g, unknown or other
  modified_base (1560)..(1560): a, c, t, g, unknown or other
  modified_base (1572)..(1572): a, c, t, g, unknown or other
  modified_base (1578)..(1578): a, c, t, g, unknown or other
  modified_base (1659)..(1659): a, c, t, g, unknown or other
  modified_base (1686)..(1686): a, c, t, g, unknown or other
  modified_base (1704)..(1704): a, c, t, g, unknown or other
  modified_base (1713)..(1713): a, c, t, g, unknown or other
  modified_base (1722)..(1722): a, c, t, g, unknown or other
  modified_base (1770)..(1770): a, c, t, g, unknown or other
  modified_base (1821)..(1821): a, c, t, g, unknown or other
  modified_base (1861)..(1861): a, c, t, g, unknown or other
  modified_base (1863)..(1863): a, c, t, g, unknown or other
  modified_base (1890)..(1890): a, c, t, g, unknown or other
  modified_base (1908)..(1908): a, c, t, g, unknown or other
  modified_base (1944)..(1944): a, c, t, g, unknown or other
  modified_base (1971)..(1971): a, c, t, g, unknown or other
  modified_base (2010)..(2010): a, c, t, g, unknown or other
  modified_base (2377)..(2379): a, c, t, g, unknown or other
  modified_base (2830)..(2832): a, c, t, g, unknown or other
  modified_base (2992)..(2993): a, c, t, g, unknown or other
  modified_base (2995)..(2995): a, c, t, g, unknown or other
  modified_base (2997)..(2997): a, c, t, g, unknown or other
  modified_base (3000)..(3000): a, c, t, g, unknown or other
  modified_base (3185)..(3185): a, c, t, g, unknown or other
  modified_base (3212)..(3214): a, c, t, g, unknown or other
  modified_base (3265)..(3265): a, c, t, g, unknown or other
  modified_base (3268)..(3268): a, c, t, g, unknown or other
  modified_base (3270)..(3270): a, c, t, g, unknown or other
  modified_base (3280)..(3280): a, c, t, g, unknown or other
  modified_base (3283)..(3283): a, c, t, g, unknown or other
  modified_base (3286)..(3287): a, c, t, g, unknown or other
  modified_base (3292)..(3292): a, c, t, g, unknown or other
  modified_base (3297)..(3297): a, c, t, g, unknown or other
  modified_base (3300)..(3300): a, c, t, g, unknown or other
  modified_base (3304)..(3304): a, c, t, g, unknown or other
  modified_base (3306)..(3306): a, c, t, g, unknown or other
  modified_base (3308)..(3308): a, c, t, g, unknown or other
  modified_base (3311)..(3311): a, c, t, g, unknown or other
  modified_base (3315)..(3316): a, c, t, g, unknown or other
  modified_base (3325)..(3326): a, c, t, g, unknown or other
  modified_base (3349)..(3349): a, c, t, g, unknown or other
  modified_base (3373)..(3373): a, c, t, g, unknown or other
  modified_base (3387)..(3387): a, c, t, g, unknown or other
  modified_base (3408)..(3408): a, c, t, g, unknown or other
  modified_base (3415)..(3415): a, c, t, g, unknown or other
  modified_base (3418)..(3420): a, c, t, g, unknown or other
  modified_base (3429)..(3430): a, c, t, g, unknown or other
  modified_base (3434)..(3434): a, c, t, g, unknown or other
  modified_base (3444)..(3444): a, c, t, g, unknown or other
  modified_base (3455)..(3455): a, c, t, g, unknown or other
  modified_base (3466)..(3466): a, c, t, g, unknown or other
  modified_base (3471)..(3471): a, c, t, g, unknown or other
  modified_base (3482)..(3482): a, c, t, g, unknown or other
  modified_base (3486)..(3486): a, c, t, g, unknown or other
  modified_base (3498)..(3498): a, c, t, g, unknown or other
  modified_base (3501)..(3501): a, c, t, g, unknown or other
  modified_base (3505)..(3505): a, c, t, g, unknown or other
  modified_base (3513)..(3513): a, c, t, g, unknown or other
  modified_base (3535)..(3535): a, c, t, g, unknown or other
  modified_base (3541)..(3541): a, c, t, g, unknown or other
  modified_base (3543)..(3543): a, c, t, g, unknown or other
  modified_base (3547)..(3548): a, c, t, g, unknown or other
  modified_base (3553)..(3553): a, c, t, g, unknown or other
  modified_base (3566)..(3566): a, c, t, g, unknown or other
  modified_base (3590)..(3590): a, c, t, g, unknown or other
  modified_base (3648)..(3648): a, c, t, g, unknown or other
  modified_base (3655)..(3655): a, c, t, g, unknown or other
  modified_base (3660)..(3660): a, c, t, g, unknown or other
  modified_base (3663)..(3664): a, c, t, g, unknown or other
  modified_base (3670)..(3671): a, c, t, g, unknown or other
  modified_base (3673)..(3674): a, c, t, g, unknown or other
  modified_base (3687)..(3687): a, c, t, g, unknown or other
  modified_base (3696)..(3696): a, c, t, g, unknown or other
  modified_base (3714)..(3714): a, c, t, g, unknown or other
  modified_base (3733)..(3733): a, c, t, g, unknown or other
  modified_base (3739)..(3739): a, c, t, g, unknown or other
  modified_base (3741)..(3741): a, c, t, g, unknown or other
  modified_base (3762)..(3762): a, c, t, g, unknown or other
  modified_base (3764)..(3764): a, c, t, g, unknown or other
  modified_base (3768)..(3768): a, c, t, g, unknown or other
  modified_base (3780)..(3780): a, c, t, g, unknown or other
  modified_base (3792)..(3792): a, c, t, g, unknown or other
  modified_base (3798)..(3798): a, c, t, g, unknown or other
  modified_base (3802)..(3802): a, c, t, g, unknown or other
  modified_base (3807)..(3807): a, c, t, g, unknown or other
  modified_base (3816)..(3816): a, c, t, g, unknown or other
  modified_base (3828)..(3828): a, c, t, g, unknown or other
  modified_base (3846)..(3846): a, c, t, g, unknown or other
  modified_base (3856)..(3856): a, c, t, g, unknown or other
  modified_base (3867)..(3867): a, c, t, g, unknown or other
  modified_base (3880)..(3880): a, c, t, g, unknown or other
  modified_base (3888)..(3888): a, c, t, g, unknown or other
  modified_base (3890)..(3890): a, c, t, g, unknown or other
  modified_base (3907)..(3907): a, c, t, g, unknown or other
  modified_base (3914)..(3914): a, c, t, g, unknown or other
  modified_base (3922)..(3922): a, c, t, g, unknown or other
  modified_base (3925)..(3925): a, c, t, g, unknown or other
  modified_base (3936)..(3936): a, c, t, g, unknown or other
  modified_base (3951)..(3951): a, c, t, g, unknown or other
  modified_base (3956)..(3956): a, c, t, g, unknown or other
  modified_base (3968)..(3968): a, c, t, g, unknown or other
  modified_base (3972)..(3972): a, c, t, g, unknown or other
  modified_base (3978)..(3978): a, c, t, g, unknown or other
  modified_base (3982)..(3983): a, c, t, g, unknown or other
  modified_base (4024)..(4024): a, c, t, g, unknown or other
  modified_base (4035)..(4037): a, c, t, g, unknown or other
  modified_base (4052)..(4052): a, c, t, g, unknown or other
  modified_base (4065)..(4065): a, c, t, g, unknown or other
  modified_base (4068)..(4069): a, c, t, g, unknown or other
  modified_base (4071)..(4072): a, c, t, g, unknown or other
  modified_base (4074)..(4074): a, c, t, g, unknown or other
  modified_base (4078)..(4079): a, c, t, g, unknown or other
  modified_base (4081)..(4081): a, c, t, g, unknown or other
  modified_base (4086)..(4086): a, c, t, g, unknown or other
  modified_base (4095)..(4095): a, c, t, g, unknown or other
  modified_base (4099)..(4099): a, c, t, g, unknown or other
  modified_base (4104)..(4106): a, c, t, g, unknown or other
  modified_base (4113)..(4114): a, c, t, g, unknown or other
  modified_base (4126)..(4126): a, c, t, g, unknown or other
  modified_base (4128)..(4131): a, c, t, g, unknown or other
  modified_base (4143)..(4143): a, c, t, g, unknown or other
  modified_base (4146)..(4146): a, c, t, g, unknown or other
  modified_base (4149)..(4149): a, c, t, g, unknown or other
  modified_base (4158)..(4158): a, c, t, g, unknown or other
  modified_base (4173)..(4173): a, c, t, g, unknown or other
  modified_base (4176)..(4178): a, c, t, g, unknown or other
  modified_base (4180)..(4185): a, c, t, g, unknown or other
  modified_base (4188)..(4191): a, c, t, g, unknown or other
  modified_base (4193)..(4197): a, c, t, g, unknown or other
  modified_base (4401)..(4401): a, c, t, g, unknown or other
  modified_base (4417)..(4417): a, c, t, g, unknown or other
  modified_base (4419)..(4419): a, c, t, g, unknown or other
  modified_base (4431)..(4431): a, c, t, g, unknown or other
  modified_base (4443)..(4443): a, c, t, g, unknown or other
  modified_base (4458)..(4458): a, c, t, g, unknown or other
  modified_base (4497)..(4497): a, c, t, g, unknown or other
  modified_base (4656)..(4656): a, c, t, g, unknown or other
  modified_base (4674)..(4674): a, c, t, g, unknown or other
  modified_base (4683)..(4683): a, c, t, g, unknown or other
  modified_base (4689)..(4689): a, c, t, g, unknown or other
  modified_base (4699)..(4699): a, c, t, g, unknown or other
  modified_base (4704)..(4705): a, c, t, g, unknown or other
  modified_base (4720)..(4721): a, c, t, g, unknown or other
  modified_base (4723)..(4723): a, c, t, g, unknown or other
  modified_base (4725)..(4725): a, c, t, g, unknown or other
  modified_base (4728)..(4728): a, c, t, g, unknown or other
  modified_base (4730)..(4730): a, c, t, g, unknown or other
  modified_base (4734)..(4734): a, c, t, g, unknown or other
  modified_base (4738)..(4738): a, c, t, g, unknown or other
  modified_base (4747)..(4749): a, c, t, g, unknown or other
  modified_base (4755)..(4756): a, c, t, g, unknown or other
  modified_base (4760)..(4760): a, c, t, g, unknown or other
  modified_base (4767)..(4767): a, c, t, g, unknown or other
  modified_base (4770)..(4771): a, c, t, g, unknown or other
  modified_base (4779)..(4780): a, c, t, g, unknown or other
  modified_base (4785)..(4785): a, c, t, g, unknown or other
  modified_base (4797)..(4797): a, c, t, g, unknown or other
  modified_base (4804)..(4804): a, c, t, g, unknown or other
  modified_base (4806)..(4806): a, c, t, g, unknown or other
  modified_base (4815)..(4815): a, c, t, g, unknown or other
  modified_base (4825)..(4828): a, c, t, g, unknown or other
  modified_base (4833)..(4833): a, c, t, g, unknown or other
  modified_base (4848)..(4848): a, c, t, g, unknown or other
  modified_base (4863)..(4863): a, c, t, g, unknown or other
  modified_base (4875)..(4875): a, c, t, g, unknown or other
  modified_base (4896)..(4896): a, c, t, g, unknown or other
  modified_base (4909)..(4909): a, c, t, g, unknown or other
  modified_base (4915)..(4915): a, c, t, g, unknown or other
  modified_base (4919)..(4919): a, c, t, g, unknown or other
  modified_base (4923)..(4924): a, c, t, g, unknown or other
  modified_base (4927)..(4927): a, c, t, g, unknown or other
  modified_base (4931)..(4931): a, c, t, g, unknown or other
  modified_base (4935)..(4935): a, c, t, g, unknown or other
  modified_base (4939)..(4939): a, c, t, g, unknown or other
  modified_base (4948)..(4948): a, c, t, g, unknown or other
  modified_base (4955)..(4956): a, c, t, g, unknown or other
  modified_base (4968)..(4968): a, c, t, g, unknown or other
  modified_base (4977)..(4977): a, c, t, g, unknown or other
  modified_base (4986)..(4986): a, c, t, g, unknown or other
  modified_base (5006)..(5007): a, c, t, g, unknown or other
  modified_base (5010)..(5010): a, c, t, g, unknown or other
  modified_base (5027)..(5028): a, c, t, g, unknown or other
  modified_base (5031)..(5031): a, c, t, g, unknown or other
  modified_base (5136)..(5136): a, c, t, g, unknown or other
  modified_base (5154)..(5154): a, c, t, g, unknown or other
  modified_base (5232)..(5232): a, c, t, g, unknown or other
  modified_base (5235)..(5235): a, c, t, g, unknown or other
  modified_base (5284)..(5284): a, c, t, g, unknown or other
  modified_base (5340)..(5340): a, c, t, g, unknown or other
  modified_base (5343)..(5343): a, c, t, g, unknown or other
  modified_base (5346)..(5346): a, c, t, g, unknown or other
  modified_base (5361)..(5361): a, c, t, g, unknown or other
  modified_base (5365)..(5367): a, c, t, g, unknown or other
  modified_base (5370)..(5370): a, c, t, g, unknown or other
  modified_base (5445)..(5445): a, c, t, g, unknown or other
  modified_base (5484)..(5484): a, c, t, g, unknown or other
  modified_base (5487)..(5487): a, c, t, g, unknown or other
  modified_base (5514)..(5514): a, c, t, g, unknown or other
  modified_base (5530)..(5530): a, c, t, g, unknown or other
  modified_base (5551)..(5551): a, c, t, g, unknown or other
  modified_base (5565)..(5565): a, c, t, g, unknown or other
  modified_base (5568)..(5568): a, c, t, g, unknown or other
  modified_base (5594)..(5594): a, c, t, g, unknown or other
  modified_base (5785)..(5787): a, c, t, g, unknown or other
  modified_base (5968)..(5970): a, c, t, g, unknown or other
  modified_base (6202)..(6204): a, c, t, g, unknown or other
  modified_base (6447)..(6448): a, c, t, g, unknown or other
  modified_base (6450)..(6451): a, c, t, g, unknown or other
  modified_base (6453)..(6453): a, c, t, g, unknown or other
  modified_base (6455)..(6462): a, c, t, g, unknown or other
  modified_base (6465)..(6465): a, c, t, g, unknown or other
  modified_base (6467)..(6470): a, c, t, g, unknown or other
  modified_base (6475)..(6476): a, c, t, g, unknown or other
  modified_base (6478)..(6478): a, c, t, g, unknown or other
  modified_base (6483)..(6483): a, c, t, g, unknown or other
  modified_base (6489)..(6490): a, c, t, g, unknown or other
  modified_base (6493)..(6493): a, c, t, g, unknown or other
  modified_base (6495)..(6495): a, c, t, g, unknown or other
  modified_base (6498)..(6501): a, c, t, g, unknown or other
  modified_base (6505)..(6507): a, c, t, g, unknown or other
  modified_base (6510)..(6510): a, c, t, g, unknown or other
  modified_base (6515)..(6519): a, c, t, g, unknown or other
  modified_base (6522)..(6528): a, c, t, g, unknown or other
  modified_base (6530)..(6531): a, c, t, g, unknown or other
  modified_base (6533)..(6536): a, c, t, g, unknown or other
  modified_base (6538)..(6542): a, c, t, g, unknown or other
  modified_base (6544)..(6547): a, c, t, g, unknown or other
  modified_base (6549)..(6553): a, c, t, g, unknown or other
  modified_base (6556)..(6557): a, c, t, g, unknown or other
  modified_base (6560)..(6562): a, c, t, g, unknown or other
  modified_base (6566)..(6569): a, c, t, g, unknown or other
  modified_base (6571)..(6576): a, c, t, g, unknown or other
  modified_base (6578)..(6580): a, c, t, g, unknown or other
  modified_base (6582)..(6582): a, c, t, g, unknown or other
  modified_base (6584)..(6587): a, c, t, g, unknown or other
  modified_base (6589)..(6590): a, c, t, g, unknown or other
  modified_base (6592)..(6592): a, c, t, g, unknown or other
  modified_base (6595)..(6611): a, c, t, g, unknown or other
  modified_base (6613)..(6613): a, c, t, g, unknown or other
  modified_base (6615)..(6615): a, c, t, g, unknown or other
  modified_base (6620)..(6621): a, c, t, g, unknown or other
  modified_base (6637)..(6637): a, c, t, g, unknown or other
  modified_base (6639)..(6639): a, c, t, g, unknown or other
  modified_base (6643)..(6643): a, c, t, g, unknown or other
  modified_base (6648)..(6649): a, c, t, g, unknown or other
  modified_base (6657)..(6658): a, c, t, g, unknown or other
  modified_base (6660)..(6660): a, c, t, g, unknown or other
  modified_base (6663)..(6664): a, c, t, g, unknown or other
  modified_base (6666)..(6666): a, c, t, g, unknown or other
  modified_base (6668)..(6668): a, c, t, g, unknown or other
  modified_base (6672)..(6673): a, c, t, g, unknown or other
  modified_base (6679)..(6684): a, c, t, g, unknown or other
  modified_base (6694)..(6694): a, c, t, g, unknown or other
  modified_base (6697)..(6697): a, c, t, g, unknown or other
  modified_base (6709)..(6709): a, c, t, g, unknown or other
  modified_base (6712)..(6714): a, c, t, g, unknown or other
  modified_base (6719)..(6719): a, c, t, g, unknown or other
  modified_base (6729)..(6730): a, c, t, g, unknown or other
  modified_base (6733)..(6734): a, c, t, g, unknown or other
  modified_base (6743)..(6743): a, c, t, g, unknown or other
  modified_base (6746)..(6746): a, c, t, g, unknown or other
  modified_base (6752)..(6752): a, c, t, g, unknown or other
  modified_base (6756)..(6756): a, c, t, g, unknown or other
  modified_base (6765)..(6765): a, c, t, g, unknown or other
  modified_base (6776)..(6777): a, c, t, g, unknown or other
  modified_base (6783)..(6783): a, c, t, g, unknown or other
  modified_base (6793)..(6793): a, c, t, g, unknown or other
  modified_base (6803)..(6803): a, c, t, g, unknown or other
  modified_base (6810)..(6810): a, c, t, g, unknown or other
  modified_base (6813)..(6815): a, c, t, g, unknown or other
  modified_base (6829)..(6830): a, c, t, g, unknown or other
  modified_base (6840)..(6840): a, c, t, g, unknown or other
  modified_base (6843)..(6844): a, c, t, g, unknown or other
  modified_base (6847)..(6848): a, c, t, g, unknown or other
  modified_base (6850)..(6855): a, c, t, g, unknown or other
  modified_base (6858)..(6859): a, c, t, g, unknown or other
  modified_base (6861)..(6862): a, c, t, g, unknown or other
  modified_base (6864)..(6872): a, c, t, g, unknown or other
  modified_base (6874)..(6874): a, c, t, g, unknown or other
  modified_base (6876)..(6877): a, c, t, g, unknown or other
  modified_base (6879)..(6882): a, c, t, g, unknown or other
  modified_base (6884)..(6884): a, c, t, g, unknown or other
  modified_base (6887)..(6889): a, c, t, g, unknown or other
  modified_base (6891)..(6892): a, c, t, g, unknown or other
  modified_base (6894)..(6894): a, c, t, g, unknown or other
  modified_base (6901)..(6905): a, c, t, g, unknown or other
  modified_base (6907)..(6908): a, c, t, g, unknown or other
  modified_base (6910)..(6910): a, c, t, g, unknown or other
  modified_base (6912)..(6916): a, c, t, g, unknown or other
  modified_base (6918)..(6918): a, c, t, g, unknown or other
  modified_base (6921)..(6921): a, c, t, g, unknown or other
  modified_base (6925)..(6927): a, c, t, g, unknown or other
  modified_base (6930)..(6931): a, c, t, g, unknown or other
  modified_base (6933)..(6937): a, c, t, g, unknown or other
  modified_base (6943)..(6943): a, c, t, g, unknown or other
  modified_base (6945)..(6946): a, c, t, g, unknown or other
  modified_base (6949)..(6955): a, c, t, g, unknown or other
  modified_base (6957)..(6958): a, c, t, g, unknown or other
  modified_base (6961)..(6963): a, c, t, g, unknown or other
  modified_base (6965)..(6967): a, c, t, g, unknown or other
  modified_base (6969)..(6971): a, c, t, g, unknown or other
  modified_base (6973)..(6973): a, c, t, g, unknown or other
  modified_base (6975)..(6977): a, c, t, g, unknown or other
  modified_base (6979)..(6981): a, c, t, g, unknown or other
  modified_base (6983)..(6983): a, c, t, g, unknown or other
  modified_base (6986)..(6993): a, c, t, g, unknown or other
  modified_base (7078)..(7134): a, c, t, g, unknown or other
  modified_base (7297)..(7299): a, c, t, g, unknown or other
  modified_base (7795)..(7795): a, c, t, g, unknown or other
  modified_base (7797)..(7797): a, c, t, g, unknown or other
  modified_base (7801)..(7801): a, c, t, g, unknown or other
  modified_base (7803)..(7803): a, c, t, g, unknown or other
  modified_base (7806)..(7806): a, c, t, g, unknown or other
  modified_base (7809)..(7809): a, c, t, g, unknown or other
  modified_base (7812)..(7814): a, c, t, g, unknown or other
  modified_base (7823)..(7823): a, c, t, g, unknown or other
  modified_base (7827)..(7829): a, c, t, g, unknown or other
  modified_base (7833)..(7834): a, c, t, g, unknown or other
  modified_base (7837)..(7839): a, c, t, g, unknown or other
  modified_base (7845)..(7846): a, c, t, g, unknown or other
  modified_base (7848)..(7849): a, c, t, g, unknown or other
  modified_base (7851)..(7855): a, c, t, g, unknown or other
  modified_base (7858)..(7858): a, c, t, g, unknown or other
  modified_base (7860)..(7863): a, c, t, g, unknown or other
  modified_base (7865)..(7865): a, c, t, g, unknown or other
  modified_base (7867)..(7867): a, c, t, g, unknown or other
  modified_base (7869)..(7871): a, c, t, g, unknown or other
  modified_base (7873)..(7873): a, c, t, g, unknown or other
  modified_base (7876)..(7876): a, c, t, g, unknown or other
  modified_base (7878)..(7878): a, c, t, g, unknown or other
  modified_base (7881)..(7882): a, c, t, g, unknown or other
  modified_base (7884)..(7884): a, c, t, g, unknown or other
  modified_base (7887)..(7892): a, c, t, g, unknown or other
  modified_base (7894)..(7895): a, c, t, g, unknown or other
  modified_base (7897)..(7897): a, c, t, g, unknown or other
  modified_base (7899)..(7899): a, c, t, g, unknown or other
  modified_base (7903)..(7903): a, c, t, g, unknown or other
  modified_base (7908)..(7908): a, c, t, g, unknown or other
  modified_base (7910)..(7910): a, c, t, g, unknown or other
  modified_base (7920)..(7920): a, c, t, g, unknown or other
  modified_base (8137)..(8139): a, c, t, g, unknown or other
  modified_base (8335)..(8352): a, c, t, g, unknown or other
  modified_base (8389)..(8389): a, c, t, g, unknown or other
  modified_base (8391)..(8391): a, c, t, g, unknown or other
  modified_base (8396)..(8397): a, c, t, g, unknown or other
  modified_base (8401)..(8402): a, c, t, g, unknown or other
  modified_base (8404)..(8404): a, c, t, g, unknown or other
  modified_base (8406)..(8409): a, c, t, g, unknown or other
  modified_base (8427)..(8427): a, c, t, g, unknown or other
  modified_base (8430)..(8431): a, c, t, g, unknown or other
  modified_base (8442)..(8442): a, c, t, g, unknown or other
  modified_base (8446)..(8446): a, c, t, g, unknown or other
  modified_base (8463)..(8463): a, c, t, g, unknown or other
  modified_base (8475)..(8475): a, c, t, g, unknown or other
  modified_base (8477)..(8477): a, c, t, g, unknown or other
  modified_base (8479)..(8480): a, c, t, g, unknown or other
  modified_base (8483)..(8483): a, c, t, g, unknown or other
  modified_base (8490)..(8490): a, c, t, g, unknown or other
  modified_base (8497)..(8499): a, c, t, g, unknown or other
  modified_base (8507)..(8507): a, c, t, g, unknown or other
  modified_base (8510)..(8511): a, c, t, g, unknown or other
  modified_base (8539)..(8539): a, c, t, g, unknown or other
  modified_base (8547)..(8547): a, c, t, g, unknown or other
  modified_base (8549)..(8549): a, c, t, g, unknown or other
  modified_base (8553)..(8553): a, c, t, g, unknown or other
  modified_base (8565)..(8565): a, c, t, g, unknown or other
  modified_base (8568)..(8568): a, c, t, g, unknown or other
  modified_base (8605)..(8606): a, c, t, g, unknown or other
  modified_base (8608)..(8608): a, c, t, g, unknown or other
  modified_base (8612)..(8612): a, c, t, g, unknown or other
  modified_base (8623)..(8623): a, c, t, g, unknown or other
  modified_base (8633)..(8633): a, c, t, g, unknown or other
  modified_base (8638)..(8639): a, c, t, g, unknown or other
  modified_base (8655)..(8655): a, c, t, g, unknown or other
  modified_base (8672)..(8672): a, c, t, g, unknown or other
  modified_base (8674)..(8674): a, c, t, g, unknown or other
  modified_base (8679)..(8679): a, c, t, g, unknown or other
  modified_base (8682)..(8682): a, c, t, g, unknown or other
  modified_base (8691)..(8691): a, c, t, g, unknown or other
  modified_base (8700)..(8700): a, c, t, g, unknown or other
  modified_base (8703)..(8703): a, c, t, g, unknown or other
  modified_base (8705)..(8705): a, c, t, g, unknown or other
  modified_base (8707)..(8707): a, c, t, g, unknown or other
  modified_base (8712)..(8712): a, c, t, g, unknown or other
  modified_base (8715)..(8715): a, c, t, g, unknown or other
  modified_base (8728)..(8728): a, c, t, g, unknown or other
  modified_base (8730)..(8730): a, c, t, g, unknown or other
  modified_base (8743)..(8743): a, c, t, g, unknown or other
  modified_base (8750)..(8750): a, c, t, g, unknown or other
  modified_base (8752)..(8752): a, c, t, g, unknown or other
  modified_base (8767)..(8767): a, c, t, g, unknown or other
  modified_base (8770)..(8770): a, c, t, g, unknown or other
  modified_base (8774)..(8774): a, c, t, g, unknown or other
  modified_base (8780)..(8780): a, c, t, g, unknown or other
  modified_base (8784)..(8784): a, c, t, g, unknown or other
  modified_base (8788)..(8788): a, c, t, g, unknown or other
  modified_base (8790)..(8790): a, c, t, g, unknown or other
  modified_base (8799)..(8799): a, c, t, g, unknown or other
  modified_base (8802)..(8802): a, c, t, g, unknown or other
  modified_base (8813)..(8814): a, c, t, g, unknown or other
  modified_base (8824)..(8824): a, c, t, g, unknown or other
  modified_base (8844)..(8844): a, c, t, g, unknown or other
  modified_base (8860)..(8861): a, c, t, g, unknown or other
  modified_base (8863)..(8863): a, c, t, g, unknown or other
  modified_base (8875)..(8875): a, c, t, g, unknown or other
  modified_base (8884)..(8884): a, c, t, g, unknown or other
  modified_base (8909)..(8909): a, c, t, g, unknown or other
  modified_base (8929)..(8929): a, c, t, g, unknown or other
  modified_base (8931)..(8931): a, c, t, g, unknown or other
  modified_base (8933)..(8933): a, c, t, g, unknown or other
  modified_base (8935)..(8935): a, c, t, g, unknown or other
  modified_base (8946)..(8946): a, c, t, g, unknown or other
  modified_base (8958)..(8958): a, c, t, g, unknown or other
  modified_base (8977)..(8978): a, c, t, g, unknown or other
  modified_base (8987)..(8987): a, c, t, g, unknown or other
  modified_base (8991)..(8992): a, c, t, g, unknown or other
  modified_base (8994)..(8994): a, c, t, g, unknown or other
  modified_base (8997)..(8997): a, c, t, g, unknown or other
  modified_base (8999)..(8999): a, c, t, g, unknown or other
  modified_base (9002)..(9002): a, c, t, g, unknown or other
  modified_base (9004)..(9004): a, c, t, g, unknown or other
  modified_base (9006)..(9006): a, c, t, g, unknown or other
  modified_base (9009)..(9009): a, c, t, g, unknown or other
  modified_base (9020)..(9020): a, c, t, g, unknown or other
  modified_base (9030)..(9030): a, c, t, g, unknown or other
  modified_base (9043)..(9043): a, c, t, g, unknown or other
  modified_base (9064)..(9065): a, c, t, g, unknown or other
  modified_base (9067)..(9067): a, c, t, g, unknown or other
  modified_base (9074)..(9075): a, c, t, g, unknown or other
  modified_base (9084)..(9084): a, c, t, g, unknown or other
  modified_base (9108)..(9108): a, c, t, g, unknown or other
  modified_base (9111)..(9111): a, c, t, g, unknown or other
  modified_base (9115)..(9115): a, c, t, g, unknown or other
  modified_base (9117)..(9117): a, c, t, g, unknown or other
  modified_base (9122)..(9122): a, c, t, g, unknown or other
  modified_base (9124)..(9124): a, c, t, g, unknown or other
  modified_base (9126)..(9126): a, c, t, g, unknown or other
  modified_base (9128)..(9128): a, c, t, g, unknown or other
  modified_base (9134)..(9134): a, c, t, g, unknown or other
  modified_base (9139)..(9140): a, c, t, g, unknown or other
  modified_base (9148)..(9148): a, c, t, g, unknown or other
  modified_base (9153)..(9153): a, c, t, g, unknown or other
  modified_base (9180)..(9181): a, c, t, g, unknown or other
  modified_base (9188)..(9190): a, c, t, g, unknown or other
  modified_base (9197)..(9198): a, c, t, g, unknown or other
  modified_base (9204)..(9204): a, c, t, g, unknown or other
  modified_base (9217)..(9217): a, c, t, g, unknown or other
  modified_base (9219)..(9219): a, c, t, g, unknown or other
  modified_base (9221)..(9221): a, c, t, g, unknown or other
  modified_base (9223)..(9224): a, c, t, g, unknown or other
  modified_base (9228)..(9228): a, c, t, g, unknown or other
  modified_base (9234)..(9234): a, c, t, g, unknown or other
  modified_base (9265)..(9265): a, c, t, g, unknown or other
  modified_base (9267)..(9267): a, c, t, g, unknown or other
  modified_base (9272)..(9273): a, c, t, g, unknown or other
  modified_base (9275)..(9275): a, c, t, g, unknown or other
  modified_base (9280)..(9280): a, c, t, g, unknown or other
  modified_base (9282)..(9282): a, c, t, g, unknown or other
  modified_base (9285)..(9286): a, c, t, g, unknown or other
  modified_base (9293)..(9293): a, c, t, g, unknown or other
  modified_base (9301)..(9301): a, c, t, g, unknown or other
  modified_base (9305)..(9305): a, c, t, g, unknown or other
  modified_base (9339)..(9339): a, c, t, g, unknown or other
  modified_base (9348)..(9348): a, c, t, g, unknown or other
  modified_base (9354)..(9354): a, c, t, g, unknown or other
  modified_base (9398)..(9398): a, c, t, g, unknown or other
  modified_base (9402)..(9402): a, c, t, g, unknown or other
  modified_base (9406)..(9406): a, c, t, g, unknown or other
  modified_base (9431)..(9431): a, c, t, g, unknown or other
  modified_base (9459)..(9459): a, c, t, g, unknown or other
  modified_base (9463)..(9463): a, c, t, g, unknown or other
  modified_base (9466)..(9466): a, c, t, g, unknown or other
  modified_base (9474)..(9474): a, c, t, g, unknown or other
  modified_base (9484)..(9484): a, c, t, g, unknown or other
  modified_base (9497)..(9497): a, c, t, g, unknown or other
  modified_base (9505)..(9505): a, c, t, g, unknown or other
  modified_base (9524)..(9524): a, c, t, g, unknown or other
  modified_base (9529)..(9529): a, c, t, g, unknown or other
  modified_base (9539)..(9539): a, c, t, g, unknown or other
  modified_base (9545)..(9545): a, c, t, g, unknown or other
  modified_base (9547)..(9547): a, c, t, g, unknown or other
  modified_base (9552)..(9552): a, c, t, g, unknown or other
  modified_base (9555)..(9555): a, c, t, g, unknown or other
  modified_base (9569)..(9569): a, c, t, g, unknown or other
  modified_base (9579)..(9579): a, c, t, g, unknown or other
  modified_base (9623)..(9623): a, c, t, g, unknown or other
  modified_base (9630)..(9630): a, c, t, g, unknown or other
  modified_base (9637)..(9638): a, c, t, g, unknown or other
  modified_base (9642)..(9642): a, c, t, g, unknown or other
  modified_base (9645)..(9645): a, c, t, g, unknown or other
  modified_base (9647)..(9648): a, c, t, g, unknown or other
  modified_base (9655)..(9655): a, c, t, g, unknown or other
  modified_base (9663)..(9663): a, c, t, g, unknown or other
  modified_base (9753)..(9753): a, c, t, g, unknown or other
  modified_base (9759)..(9759): a, c, t, g, unknown or other
  modified_base (9832)..(9832): a, c, t, g, unknown or other
  modified_base (9834)..(9835): a, c, t, g, unknown or other
  modified_base (9837)..(9837): a, c, t, g, unknown or other
  modified_base (10426)..(10426): a, c, t, g, unknown or other
  modified_base (10440)..(10440): a, c, t, g, unknown or other
  modified_base (10485)..(10485): a, c, t, g, unknown or other
  modified_base (10494)..(10494): a, c, t, g, unknown or other
  modified_base (10503)..(10503): a, c, t, g, unknown or other
  modified_base (10555)..(10555): a, c, t, g, unknown or other
  modified_base (10557)..(10557): a, c, t, g, unknown or other
  modified_base (10559)..(10559): a, c, t, g, unknown or other
  modified_base (10561)..(10568): a, c, t, g, unknown or other
  modified_base (10571)..(10574): a, c, t, g, unknown or other
  modified_base (10578)..(10580): a, c, t, g, unknown or other
  modified_base (10582)..(10583): a, c, t, g, unknown or other
  modified_base (10585)..(10585): a, c, t, g, unknown or other
  modified_base (10587)..(10587): a, c, t, g, unknown or other
  modified_base (10590)..(10591): a, c, t, g, unknown or other
  modified_base (10594)..(10594): a, c, t, g, unknown or other
  modified_base (10598)..(10598): a, c, t, g, unknown or other
  modified_base (10602)..(10603): a, c, t, g, unknown or other
  modified_base (10605)..(10607): a, c, t, g, unknown or other
  modified_base (10609)..(10609): a, c, t, g, unknown or other
  modified_base (10613)..(10613): a, c, t, g, unknown or other
  modified_base (10616)..(10617): a, c, t, g, unknown or other
  modified_base (10624)..(10624): a, c, t, g, unknown or other
  modified_base (10626)..(10628): a, c, t, g, unknown or other
  modified_base (10630)..(10630): a, c, t, g, unknown or other
  modified_base (10632)..(10632): a, c, t, g, unknown or other
  modified_base (10634)..(10634): a, c, t, g, unknown or other
  modified_base (10637)..(10637): a, c, t, g, unknown or other
  modified_base (10639)..(10639): a, c, t, g, unknown or other
  modified_base (10642)..(10643): a, c, t, g, unknown or other
  modified_base (10646)..(10646): a, c, t, g, unknown or other
  modified_base (10648)..(10649): a, c, t, g, unknown or other
  modified_base (10651)..(10653): a, c, t, g, unknown or other
  modified_base (10656)..(10656): a, c, t, g, unknown or other
  modified_base (10658)..(10659): a, c, t, g, unknown or other
  modified_base (10661)..(10661): a, c, t, g, unknown or other
  modified_base (10668)..(10668): a, c, t, g, unknown or other
  modified_base (10672)..(10673): a, c, t, g, unknown or other
  modified_base (10675)..(10679): a, c, t, g, unknown or other
  modified_base (10682)..(10683): a, c, t, g, unknown or other
  modified_base (10692)..(10693): a, c, t, g, unknown or other
  modified_base (10696)..(10698): a, c, t, g, unknown or other
  modified_base (10700)..(10702): a, c, t, g, unknown or other
  modified_base (10705)..(10707): a, c, t, g, unknown or other
  modified_base (10711)..(10711): a, c, t, g, unknown or other
  modified_base (10713)..(10713): a, c, t, g, unknown or other
  modified_base (10729)..(10729): a, c, t, g, unknown or other
  modified_base (10740)..(10740): a, c, t, g, unknown or other
  modified_base (10745)..(10745): a, c, t, g, unknown or other
  modified_base (10750)..(10750): a, c, t, g, unknown or other
  modified_base (10754)..(10754): a, c, t, g, unknown or other
  modified_base (10758)..(10758): a, c, t, g, unknown or other
  modified_base (10782)..(10782): a, c, t, g, unknown or other
  modified_base (10793)..(10794): a, c, t, g, unknown or other
  modified_base (10797)..(10797): a, c, t, g, unknown or other
  modified_base (10810)..(10810): a, c, t, g, unknown or other
  modified_base (10815)..(10815): a, c, t, g, unknown or other
  modified_base (10857)..(10857): a, c, t, g, unknown or other
  modified_base (10860)..(10860): a, c, t, g, unknown or other
  modified_base (10866)..(10866): a, c, t, g, unknown or other
  modified_base (10875)..(10875): a, c, t, g, unknown or other
  modified_base (10887)..(10887): a, c, t, g, unknown or other
  modified_base (10890)..(10890): a, c, t, g, unknown or other
  modified_base (10897)..(10897): a, c, t, g, unknown or other
  modified_base (10904)..(10904): a, c, t, g, unknown or other
  modified_base (10917)..(10917): a, c, t, g, unknown or other
  modified_base (10935)..(10935): a, c, t, g, unknown or other
  modified_base (10947)..(10947): a, c, t, g, unknown or other
  modified_base (10964)..(10964): a, c, t, g, unknown or other
  modified_base (10982)..(10982): a, c, t, g, unknown or other
  modified_base (10986)..(10988): a, c, t, g, unknown or other
  modified_base (10992)..(10993): a, c, t, g, unknown or other
  modified_base (11000)..(11000): a, c, t, g, unknown or other
  modified_base (11022)..(11023): a, c, t, g, unknown or other
  modified_base (11035)..(11035): a, c, t, g, unknown or other
  modified_base (11046)..(11046): a, c, t, g, unknown or other
  modified_base (11064)..(11064): a, c, t, g, unknown or other
  modified_base (11085)..(11085): a, c, t, g, unknown or other
  modified_base (11091)..(11091): a, c, t, g, unknown or other
  modified_base (11103)..(11103): a, c, t, g, unknown or other
  modified_base (11110)..(11110): a, c, t, g, unknown or other
  modified_base (11137)..(11137): a, c, t, g, unknown or other
  modified_base (11163)..(11163): a, c, t, g, unknown or other
  modified_base (11174)..(11174): a, c, t, g, unknown or other
  modified_base (11177)..(11177): a, c, t, g, unknown or other
  modified_base (11179)..(11179): a, c, t, g, unknown or other
  modified_base (11182)..(11182): a, c, t, g, unknown or other
  modified_base (11184)..(11184): a, c, t, g, unknown or other
  modified_base (11197)..(11197): a, c, t, g, unknown or other
  modified_base (11227)..(11227): a, c, t, g, unknown or other
  modified_base (11232)..(11234): a, c, t, g, unknown or other
  modified_base (11239)..(11239): a, c, t, g, unknown or other
  modified_base (11245)..(11245): a, c, t, g, unknown or other
  modified_base (11251)..(11251): a, c, t, g, unknown or other
  modified_base (11253)..(11253): a, c, t, g, unknown or other
  modified_base (11262)..(11262): a, c, t, g, unknown or other
  modified_base (11264)..(11264): a, c, t, g, unknown or other
  modified_base (11276)..(11276): a, c, t, g, unknown or other
  modified_base (11306)..(11307): a, c, t, g, unknown or other
  modified_base (11309)..(11310): a, c, t, g, unknown or other
  modified_base (11349)..(11349): a, c, t, g, unknown or other
  modified_base (11355)..(11355): a, c, t, g, unknown or other
  modified_base (11358)..(11360): a, c, t, g, unknown or other
  modified_base (11368)..(11368): a, c, t, g, unknown or other
  modified_base (11372)..(11372): a, c, t, g, unknown or other
  modified_base (11375)..(11375): a, c, t, g, unknown or other
  modified_base (11385)..(11385): a, c, t, g, unknown or other
  modified_base (11389)..(11389): a, c, t, g, unknown or other
  modified_base (11391)..(11391): a, c, t, g, unknown or other
  modified_base (11395)..(11395): a, c, t, g, unknown or other
  modified_base (11402)..(11402): a, c, t, g, unknown or other
  modified_base (11410)..(11410): a, c, t, g, unknown or other
  modified_base (11415)..(11415): a, c, t, g, unknown or other
  modified_base (11427)..(11428): a, c, t, g, unknown or other
  modified_base (11433)..(11433): a, c, t, g, unknown or other
  modified_base (11435)..(11436): a, c, t, g, unknown or other
  modified_base (11476)..(11476): a, c, t, g, unknown or other
  modified_base (11481)..(11481): a, c, t, g, unknown or other
  modified_base (11486)..(11486): a, c, t, g, unknown or other
  modified_base (11496)..(11496): a, c, t, g, unknown or other
  modified_base (11501)..(11501): a, c, t, g, unknown or other
  modified_base (11519)..(11520): a, c, t, g, unknown or other
  modified_base (11533)..(11533): a, c, t, g, unknown or other
  modified_base (11592)..(11592): a, c, t, g, unknown or other
  modified_base (11599)..(11599): a, c, t, g, unknown or other
  modified_base (11607)..(11607): a, c, t, g, unknown or other
  modified_base (11616)..(11616): a, c, t, g, unknown or other
  modified_base (11622)..(11622): a, c, t, g, unknown or other
  modified_base (11627)..(11627): a, c, t, g, unknown or other
  modified_base (11639)..(11639): a, c, t, g, unknown or other
  modified_base (11644)..(11644): a, c, t, g, unknown or other
  modified_base (11667)..(11667): a, c, t, g, unknown or other
  modified_base (11680)..(11681): a, c, t, g, unknown or other
  modified_base (11701)..(11701): a, c, t, g, unknown or other
  modified_base (11728)..(11728): a, c, t, g, unknown or other
  modified_base (11748)..(11748): a, c, t, g, unknown or other
  modified_base (11784)..(11784): a, c, t, g, unknown or other
  modified_base (11802)..(11802): a, c, t, g, unknown or other
  modified_base (11805)..(11805): a, c, t, g, unknown or other
  modified_base (11828)..(11829): a, c, t, g, unknown or other
  modified_base (11834)..(11834): a, c, t, g, unknown or other
  modified_base (11845)..(11845): a, c, t, g, unknown or other
  modified_base (11860)..(11862): a, c, t, g, unknown or other
  modified_base (11865)..(11865): a, c, t, g, unknown or other
  modified_base (11867)..(11867): a, c, t, g, unknown or other
  modified_base (11872)..(11872): a, c, t, g, unknown or other
  modified_base (11874)..(11874): a, c, t, g, unknown or other
  modified_base (11889)..(11889): a, c, t, g, unknown or other
  modified_base (11910)..(11910): a, c, t, g, unknown or other
  modified_base (11928)..(11928): a, c, t, g, unknown or other
  modified_base (11930)..(11931): a, c, t, g, unknown or other
  modified_base (11974)..(11974): a, c, t, g, unknown or other
  modified_base (11992)..(11992): a, c, t, g, unknown or other
  modified_base (11996)..(11996): a, c, t, g, unknown or other
  modified_base (12006)..(12006): a, c, t, g, unknown or other
  modified_base (12009)..(12009): a, c, t, g, unknown or other
  modified_base (12013)..(12013): a, c, t, g, unknown or other
  modified_base (12049)..(12049): a, c, t, g, unknown or other
  modified_base (12052)..(12052): a, c, t, g, unknown or other
  modified_base (12059)..(12060): a, c, t, g, unknown or other
  modified_base (12070)..(12070): a, c, t, g, unknown or other
  modified_base (12073)..(12073): a, c, t, g, unknown or other
  modified_base (12087)..(12087): a, c, t, g, unknown or other
  modified_base (12090)..(12090): a, c, t, g, unknown or other
  modified_base (12096)..(12096): a, c, t, g, unknown or other
  modified_base (12108)..(12112): a, c, t, g, unknown or other
  modified_base (12114)..(12115): a, c, t, g, unknown or other
  modified_base (12117)..(12117): a, c, t, g, unknown or other
  modified_base (12121)..(12121): a, c, t, g, unknown or other
  modified_base (12123)..(12123): a, c, t, g, unknown or other
  modified_base (12125)..(12125): a, c, t, g, unknown or other
  modified_base (12127)..(12130): a, c, t, g, unknown or other
  modified_base (12140)..(12140): a, c, t, g, unknown or other
  modified_base (12157)..(12157): a, c, t, g, unknown or other
  modified_base (12176)..(12176): a, c, t, g, unknown or other
  modified_base (12190)..(12190): a, c, t, g, unknown or other
  modified_base (12231)..(12231): a, c, t, g, unknown or other
  modified_base (12234)..(12234): a, c, t, g, unknown or other
  modified_base (12243)..(12245): a, c, t, g, unknown or other
  modified_base (12250)..(12251): a, c, t, g, unknown or other
  modified_base (12257)..(12259): a, c, t, g, unknown or other
  modified_base (12270)..(12270): a, c, t, g, unknown or other
  modified_base (12272)..(12273): a, c, t, g, unknown or other
  modified_base (12275)..(12275): a, c, t, g, unknown or other
  modified_base (12286)..(12287): a, c, t, g, unknown or other
  modified_base (12292)..(12292): a, c, t, g, unknown or other
  modified_base (12300)..(12300): a, c, t, g, unknown or other
  modified_base (12302)..(12302): a, c, t, g, unknown or other
  modified_base (12313)..(12313): a, c, t, g, unknown or other
  modified_base (12315)..(12321): a, c, t, g, unknown or other
  modified_base (12323)..(12327): a, c, t, g, unknown or other
  modified_base (12330)..(12330): a, c, t, g, unknown or other
  modified_base (12333)..(12334): a, c, t, g, unknown or other
  modified_base (12337)..(12337): a, c, t, g, unknown or other
  modified_base (12339)..(12339): a, c, t, g, unknown or other
  modified_base (12342)..(12343): a, c, t, g, unknown or other
  modified_base (12345)..(12353): a, c, t, g, unknown or other
  modified_base (12356)..(12363): a, c, t, g, unknown or other
  modified_base (12366)..(12367): a, c, t, g, unknown or other
  modified_base (12369)..(12369): a, c, t, g, unknown or other
  modified_base (12371)..(12373): a, c, t, g, unknown or other
  modified_base (12375)..(12378): a, c, t, g, unknown or other
  modified_base (12381)..(12382): a, c, t, g, unknown or other
  modified_base (12385)..(12385): a, c, t, g, unknown or other
  modified_base (12387)..(12387): a, c, t, g, unknown or other
  modified_base (12391)..(12393): a, c, t, g, unknown or other
  modified_base (12397)..(12401): a, c, t, g, unknown or other
  modified_base (12403)..(12405): a, c, t, g, unknown or other
  modified_base (12408)..(12412): a, c, t, g, unknown or other
  modified_base (12414)..(12416): a, c, t, g, unknown or other
  modified_base (12418)..(12423): a, c, t, g, unknown or other
  modified_base (12428)..(12429): a, c, t, g, unknown or other
  modified_base (12432)..(12433): a, c, t, g, unknown or other
  modified_base (12436)..(12438): a, c, t, g, unknown or other
  modified_base (12440)..(12442): a, c, t, g, unknown or other
  modified_base (12444)..(12448): a, c, t, g, unknown or other
  modified_base (12450)..(12450): a, c, t, g, unknown or other
  modified_base (12454)..(12457): a, c, t, g, unknown or other
  modified_base (12460)..(12462): a, c, t, g, unknown or other
  modified_base (12465)..(12466): a, c, t, g, unknown or other
  modified_base (12468)..(12471): a, c, t, g, unknown or other
  modified_base (12473)..(12476): a, c, t, g, unknown or other
  modified_base (12481)..(12481): a, c, t, g, unknown or other
  modified_base (12483)..(12484): a, c, t, g, unknown or other
  modified_base (12486)..(12489): a, c, t, g, unknown or other
  modified_base (12769)..(12885): a, c, t, g, unknown or other
  modified_base (13158)..(13158): a, c, t, g, unknown or other
  modified_base (13161)..(13161): a, c, t, g, unknown or other
  modified_base (13164)..(13164): a, c, t, g, unknown or other
  modified_base (13167)..(13167): a, c, t, g, unknown or other
  modified_base (13179)..(13179): a, c, t, g, unknown or other
  modified_base (13182)..(13185): a, c, t, g, unknown or other
  modified_base (13188)..(13191): a, c, t, g, unknown or other
  modified_base (13193)..(13194): a, c, t, g, unknown or other
  modified_base (13196)..(13198): a, c, t, g, unknown or other
  modified_base (13203)..(13203): a, c, t, g, unknown or other
  modified_base (13207)..(13214): a, c, t, g, unknown or other
  modified_base (13224)..(13227): a, c, t, g, unknown or other
  modified_base (13230)..(13230): a, c, t, g, unknown or other
  modified_base (13234)..(13235): a, c, t, g, unknown or other
  modified_base (13237)..(13237): a, c, t, g, unknown or other
  modified_base (13240)..(13243): a, c, t, g, unknown or other
  modified_base (13246)..(13256): a, c, t, g, unknown or other
  modified_base (13258)..(13258): a, c, t, g, unknown or other
  modified_base (13260)..(13264): a, c, t, g, unknown or other
  modified_base (13266)..(13267): a, c, t, g, unknown or other
  modified_base (13269)..(13269): a, c, t, g, unknown or other
  modified_base (13273)..(13273): a, c, t, g, unknown or other
  modified_base (13275)..(13275): a, c, t, g, unknown or other
  modified_base (13277)..(13278): a, c, t, g, unknown or other
  modified_base (13281)..(13281): a, c, t, g, unknown or other
  modified_base (13284)..(13287): a, c, t, g, unknown or other
  modified_base (13290)..(13290): a, c, t, g, unknown or other
  modified_base (13295)..(13295): a, c, t, g, unknown or other
  modified_base (13297)..(13309): a, c, t, g, unknown or other
  modified_base (13311)..(13312): a, c, t, g, unknown or other
  modified_base (13314)..(13318): a, c, t, g, unknown or other
  modified_base (13320)..(13320): a, c, t, g, unknown or other
  modified_base (13322)..(13322): a, c, t, g, unknown or other
  modified_base (13324)..(13328): a, c, t, g, unknown or other
  modified_base (13330)..(13330): a, c, t, g, unknown or other
  modified_base (13335)..(13335): a, c, t, g, unknown or other
  modified_base (13339)..(13342): a, c, t, g, unknown or other
  modified_base (13344)..(13344): a, c, t, g, unknown or other
  modified_base (13346)..(13354): a, c, t, g, unknown or other
  modified_base (13356)..(13360): a, c, t, g, unknown or other
  modified_base (13365)..(13368): a, c, t, g, unknown or other
  modified_base (13370)..(13371): a, c, t, g, unknown or other
  modified_base (13373)..(13376): a, c, t, g, unknown or other
  modified_base (13378)..(13387): a, c, t, g, unknown or other
  modified_base (13389)..(13390): a, c, t, g, unknown or other
  modified_base (13392)..(13393): a, c, t, g, unknown or other
  modified_base (13395)..(13395): a, c, t, g, unknown or other
  modified_base (13398)..(13398): a, c, t, g, unknown or other
  modified_base (13407)..(13407): a, c, t, g, unknown or other
  modified_base (13486)..(13488): a, c, t, g, unknown or other
  modified_base (13714)..(14262): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcgctttgcggtgtggccaagaaggcctgccacnagggcgaattccgatgcaacaacngccgttgcattccccacaantgggaatgcgacggcgacaacgattgcggggatggctcggacgaggaggactgcaccnaccacnactgccagcccgacatgtggcaatgcgacaagtncnaatggcannncgncaaatgcattcccnantnctagcgttgcgatggcaacaacgactgcgaggatgggtccgatgagaaggattgcccctcannccnggtcaactgnaatgncggctcggtgttctcctgngccaanggccgncaatgctttcccatnggcaggaattgcgatggcnactacgattgtngngacctcagcgatgagaagganncttgcncggccnatcataccnantgcacggccnaccagttccagtgngccgacaactccaantgcattccacaggtntgganttgcgatggggaggacgattgcgcggatggnnntgatgagccgganacttgngangtncngncctgcnacaanggcgagttccagtgcaccaacagccattgcatcccccccanatnggaatgcgacggtgacaacgantgnggngacggctcggatgaggaggactgcncncacnacaantgcccgcccgacntctggcnatgccccaatnncgggcattgcatcccccagaggaanctttgcgatggcaacnacgactgcgaggatgggnccgacgagnagcattgcacgagcaatctgtgcccaacgctgggctgccagtcgggctgccataactcaccagaaggcccaatttgctcgtgtcctttgggcgaacaattaatcaanaaatttcanacacgctgtgaacccgaaaangaatgccttgatccacgctcgtgttcccaacattgcacggacgagaagcatggcttcacttgcagttgtcttggctcctgtttcnnnnnnnnnnnnnnnnnnnnnnnnggcaacagcaatctgacacttcgcggctattgcatctccaacgatccccagaatatgcgcnnntttttgtgcccgnnnnnnggnnnnnnncggttgaatccggcgaataaagaagaatctgccgtcaaaattgcatctggcgaattcatttacggcgttgactttgactangagcagaagaagatgttctggactgaccggctggcgcatgcccttttccgcgcagacattacgcccagcggagacattgagcacatcaagaagctggacttgaaatcgttgatttacccaaggaatntngcngtcgattggntcnncagnaanttgtattgggtggattcttcgttgaacacaatcganattggcagtttggagaancctntacgtgccgttcttgtncacgaaggaattgatcagccccgagggttggcngtggatccccgngtggcnttgatgttctggacagaccatccgcgcattgagcgtgccaacatggacggcacaaacagggtggtgctggttgacacaaanatttactggcccaactcaattgcactngacttcaccacaaatcgngtctacttngcggattcnaagctggactacattgacttcgttgactacgatggcaaaggacgcacncaagtgctggcatccaccaaattcatccaacacccgcatgccatgtccatnttcgaggaccacatctactacagtgatcgtcgcctccagngncttcaactctacccaaaatacccgaanggcaccaatcgggaatanccatcccacactttctccaaattcgcccttggcgtngtcactgtccatccagtgcttcaaccngccatcaaggaacagccgtgtgccggcaatccatgttcncacatttgtgccaaagcggagtgccaagggatgtgcctgctcagcaaagacaatgtcggttttggtgttggctatcgctgcgcctgtccaattggccaaaagcttgttgatggcaaacgttgtgtggccgcaatggactatttgctgttcagcagcaacaaagttgtgcgtggcatttacccggaaaacatgcaaaactcgctggccgaagccgtgctgcccatctcgccccaatcccaacgccgcattggaatgtattttgcggttgaatgtgacgtgcatggctccagcttcttctacgctgacatcatggacaacacgctgtaccgggtgaaaccggacggagaaggtgcggcacccattttgnnnacccacaacgatggcctcatctccatgtcctttgactggatggccaagcagctctactatgtggacaacatccgaaattcactggaagttgtgaaagtggccgagccagggctggtcaatcccgaacaacttgtgcgccgtcaactgctcatcaaactgcgcgaaccaatttccgttgttgtccatccatggcgtgggctgcttttcttcgctgaagcggaaaggccggcacgcatttggcgatgcaacatggacgcaactggctgcattgttctccgcaatgtgacattgggaagaccgtcgggattggccattgactttgcggaaagtcgtttgtgcatgtccgattcattgctgaagctgtttgcgtgcatggactttgatggccagaactgggcagtcatcccggttgaggaccaaatcccagtggccatgacctgcttggaccaannnatctattacgtccatcaacggccatactccattcgccgggtgtccaaaaactttggcggagccggccggctggtacgcgacttcagcaaggaggaacgcagcattttctccatcaaaggatgctcaatggagaaccagccaatgacggatgccagccacnngnanccntgtcatgagcacaactgtgcccacttctgctttgccgtgcccagtgaggaccgtgccgcaccgttggcaaagaagtgtgcctgcaaacagggctacaaggtgaacccgaacaacgagttggcctgcatccgtgacatcatggaaccggtggagccactttgcgcgtgcaacaagggcgaattccngtgcgccaacggccattgcatccccgnnncgtgggaatgcgacggggacaacgattgccgggatgggtcggatgagctgnacnanaatggcaagnctnccnnggagnaaaangantgcnangnggncaanntccggtgcnncaacaccaacaagtgcatccccncggcgtgggtttgcgacggggacnacgattgtggggangggtcggatgaggatgagaangtctgcnctnnnggcaagcannccgnctgccccganggcgaattccngtgcgccaacnacaantgcatccccgncacntggcaatgcganggngacnacgattgnggggatgggtcggatgagcagnaggagntntgcnncaacnaagcctgcccgcncggctagttccagtgcgccaacgncaaatgcattcccaagaaatggcactgcgatggggacaacgattgtggggatggctcngatgagnagcangannattgcnngnncgccgagtgccangcggaccanttccggtgcgccaacgcnaacaattgcatccacgcgncgtagnantgcgatggggacgacgattgngnggangggtcggatgancagcagtgcagntgcccngacnacgantgcgcggcngaccagttccantgcgccaacaaccacaantgcattcccncgaaatggcantgcgatggcgacnacgattgngnggatgggtcggatgagnagcacancgattgcncgnacgaacacaantgcccggccgaccanttccnatgcgacaacgncaantgcatncccnngacttggaattgcgatggcgacaacgattgtggggatggcnccgatgaggannngcagcgcaactgcanggcctcccaggangannannantgcnncnacganaacttgcantgcnacaannncaaagannagtgcattcccnannnntggatctgcganggngangacgattgnggggatggttcggangannntnnnnnntgnnnnannnnnctttgcgcggctgaccgtgccggttgtcaattcaaatgccataactcaccagaaggcccaatttgctcatgtcctttgggcgaacaattaatcaataaaacacgctgtgaacccgaaaacgaatgccttgatccacgctcgtgttcccaacattgcacggacgagaagcatggcttcacttgcagttgtgatgctggatatganctggcagcggacaaangnacctgtaaagtnggtgaaaatcgnggggacatgcgcgtntacgtgtccaatcggaatcgcatctattggtcggacagnaacctcgaaaattggcgaacttttgcagcacaggtggaaaatgccgtggcaattgcttgggattccgttcaagacaggatttactggtcagacatccgggacaagaaaatctacagtgccagcaagaatggcacagacgtgcaggtgttcattggccanggcttggacatcaccganggaattgcngtcgantgggttggcngaaanntgtattgggtggatnntncnctnancacnatcnaaattggcnnnttggannaacntggattncgnncagttctnntccangaccgaattgancagcccngngcgattgcngtggaccccnnnntgggnttgatgttctggacngactggggccaacanccgagcattgancgtgccaacatggacggcacnaacaggctggtgntggtcnacanaganntgnactngccnaacncattggcantggactnnaccacaaatcgngtctacttngcggacgcnaagctggactgcattgactnngtngactacgatggcaaagnncgnactcaagtgctggcatccaccaaattcatccaacacccgcatgccatgtccatcttcgaggaccacatttactacagtgatcgtcgcctccagaggcttcaactntacccaaaatacccgaanggcaccaatcgggaatatccatcccacactttctccaaagcccttggcgtagtcactgtccatccagtgcttcaaccngcnatcaaggaacagccgtgtgccggcaatccatgttcccacatttgcgcantgggtgccaacaaaacattcacatgcatttgcccaagtggacatgtgctggaccanaanagncaccaatgtgtgctngacnnnagncccttcatgttgttggtgcaccgcacaatgattgttggtgccgcactgaacacgggaagcaaacagaaggaacangagatggccggcattgtgccaatcagcggccttcagaanacntacgatgccgactacgacccgttgacnaacgagatgttccatntggagcatggaagtgcggccngactgatcgccacnctnctttccgatgccagaatctacaaaantagtctggtgaacaacaaccgaacccagattctcaccacccaacagcccaacgacccattctgcatggcctacgattggaacggccggaatttgtacattggcaacaaactgtcgcagaccattgaaatcgtgcgcacccaaggggaacaataccgtgccatcataatgcacaatgaccaaacaccaaccnnngtctcacaacccgtggcaattgccgtcgactccgaccgtggccttctgttttggcttgaccaaggcaagggcggcctgtccacaaaggttggccgtgccgacatggacggcaacaacccgctggtgttggtcaacattgacttggccgagctggaccatttggcgttggacaccaccaacnnncgggtctacttcaccgaagccaaggctggccgcatcaccagtgtctcatacgagggccaagacaagcattacgtgctgaacgatgcgggcaaacagccgcgtgccattgccttctacaacaaccacatttactactcggactctgcctttgacaagatcatggtgggcgaagtggttggcgatgagcagccaccggagttcacggaattccgggccaacgtggaacatctgnnnaatctgcgcgttgtccatccaagtgccaacactgaatcccacccgtgccacaacaacaacggcaactgcgaccacatttgcatccctggccaacactccaagtttacgtgcatttgtggcactgggtacacactagacgaggcgaccaactgcaagctgttctccgactcattcctggttgtggccggcaaaaactacatcaaatccattccaaccgaccaaatgcgcaccaaagtcacagcnntnnanannnnnnnnggngnnnncattnncngcgtngacttnnacnangannnnaagnnnatnttctnnnnngannnnnnngnncnnnncnnnnncnnnncnnnnnttnngcnnngcgnnnncnnnnnncnnntnannnngnngnacnnnnnnnnnnnnnnnnncntnaaagnnttggccgtcgattggntnagcngcaanntgtacttnntnaanngngnctcnnaacggnnnnnnattgatgtgngcnagttggatggcnacnnncgcancatactgatnncgnnccggactgngcngccaanggcnattgcggtngacccgatcannggctanatgttcttcnccgaccagtnccagcanccnnncattgaacgcgcanngctggatggnacnnacnngnnnnnnctnntnnannnnnnnnngnannannnnancgnnntnntngtggacnnnnncnncnannnnntntantggnnnganncnnnnntggatngnnttnnnnnnntnnacnnngnnngnnntnannngnnncngannnnnnnntgaagccggaattggtgcggtctgatattgcagaagcaaccgatgtattggacggaccggagactggagaaagtgtttgcagcannnnnnnnnnnnnnnnnnnnnnnnnnnnnnnnnnnnnnnnnnnnnnnnnnnnnnnnnttgcccgaactgtccgacttggccgcattcgacccactggcccagcccaagtccagttctccgtgtcacatcagcgaaagtctgcgcaaatcgccctgccctcaactctgctttgccgtgcccggctcatccgcccccaactgcgcttgtgccaagggcgtgnnnaagggtcgcgtttgtgaggagcccgacaccttcatgatgttcatcgatggcgaccgcattgttgatgccaccgtggtgcccgacatcaaagccagttccccactgcgcgaggcgttcccgcccttcccgaacattcaactgtttgacgtggacgtgaacttgcggcgaatctatgtggccactgagtcgccggctggcgccaacatcacctggttttccatgagccagccaaagcagctcaggcaaatcatcaacgcggaaagactgcgcactgccgagagcagccggcacatttccgacatgcgcttggattggctgacgcaaaagatctattggacaactggccggactggaaagctctatgccttcgacatcaaaaacaaccacattgtgacaattgcctccggtgactggacatacgcactggcgctggacccatgcgcgggactcatcttctggtccgacagcggctacaaagtgacgggtggcgcctatnanccgngnatngancgnnncaacatggncggnnnaaannggnnngtgatnntnnannnnnacntnnnntngncnnncncantngcnntngannnnnncnnanancgantctantnggcggactcnaagctggactacattgacttcgttgactacgatggcaaaggacgccgcatcattggcattgggttccgagcaaaatcactggacatttgggagaattggctgtacttgagtgacccactctcaaacggcattttccgaatgaacaaattcacgggcaacaactacgagagtgtggcacccgaccaccggctgcccggcactgtgcgcattttggcgnnngaagcggacatccgcacgcgcaaccaatggtgcaatgaggcgaccgcccatttgtgtgccaaaaacaacggtggatgcgagcaaatttgccacgtcattccggatgaatcgggcgcacccgcaaacaaagtccaatgcgcttgcaatgacaccttccagctggtgaagcagcccggcgaggatgcggccacccagnnnnnnnnnnnnnnnnnnaatgaagcggcaaagacaacatgtgaaggcccctacnanttccnntgcnncnannnnaaatgcattcccatggantgnncctgcgacggngacnacgattgtggggatgcntcggatgaagcncngnnctnctgtgangaccgannntgcccggntgnntagttccaatgcgccaaccacagatgcnttccggantnggcnatttgcgatggngangacgattgcggggatgggtcggacgagctggactgcnncnacgnggccgcctgcncggacggcangttcnngtgcaccaacggcaantgcatcccccggcgatngncttgnganggggacaangattgtggngangngncggantcngatgaagatcatngncactgcccaggcnagcccancnactgccgcgcggacnaantccnctgcgncaanaccnanaaatgcatnccncagaaataccnntgcgatggcnacgacgattgtggggacgantcggacgaggaggggnngntctgccgcaacnacaaatgcncggccgacaagttccgctgccccancggccattgcattcccgagncntngnaatgcgatggngacaacgattgnggggatgggtccgacgagnngcacgacanttgnnangangncgngngncanaaccactgccnggacgactanatgttccaatgcnacaaccacaaatgcattcccnngnaatgganntgcgatggngacgacgattgtggggatggctcngangagnanaagcngnananctgtgncaacnncccctgcnccganaaggagttcaaatgcgccgacaccggnnattgcannnagcccanntagaantgcattcccaagnantngnnctgngatggngacgacgattgtggcgatggttcggatgaanancaggnncnctgcnanaanncgcacanccagtgcnacancggcgaattccggtgcaacaaccaccaatgcatnccccacaantggcantgcgacggcgacgacgattgtggggatgggtcggacgaggaggnggantgcngtcaccacgactgcccgcccgacangttccaatgcgccaaccacaaatgcatncccnagngttggctntgcgatggcnacgacgactgcgnggatggcnccgacgagcagcagtgcgngccgnacgctgccgnaattcngnacggncanaactgtgccaaggnccaataccantgccagaacgggcaatgcattgaaatgcacaaagtgtgcgacanccaatangattgcnnggancgnanngacgaangtccaaantgctttgtgaacgaatgtgaacgtgctgaacatccgctgtgtgaacaacgctgcgttgaccaactgattggctacaagtgcgaatgtganagcggntttgcgctgaacccacaggacaagaggtcgtgccaggacattgacgagtgcatggagggcctgtcgctgtgtncnnancaatgcgagaacaaacagggcagctacaagtgcgcctgtgctgacggcttcacgttggcctcggacgagtacagttgcaaaccgacccaggcgcagaaggaaccctacctgctgttggccaacaaacactacatccggaagatctccattgacgggtcacggtacgagctggttgcgcaaggctttgagaatgttgtggccatggacgtggacccaattgaggagcaagtctatctgctggatgccggcaaactgcgtgtctaccgcaaatccctgcatcgtctgagtgaggcgccctccagctacgaccaaatcatgcggcataacgtgtttggcgtggaaggcattgccgtcgactgggttggccgcaaactgtactccctcaatcggcaagaccgttcgctgcgtgtttgcgagttggatggccgcttctgtcgcacactgatccgggaccggattgcgcagccaaaggcgattgcggtgcacccgaagaagggctacctgtacttcagtgagtggtccctgcaaccgtacattgcccgggttgcgctggacggaagtgcgccgtttgccgacccaattgtgaagntggttgacacaaanatttactggcccaactcgattgcacttgacttcaccacaaatcgngtctatttngcggattcnaagctggactacattgacttcgttgactacgatggcaaaggacgcacccaantncngnnnnnnnncannnnacannngnntncnatnnccntgtncgannannncntgtnctnnagtgatngnnncntncngcnanttnnacngnncnnnaantnnantggcacnaatnngnnnnngcnntcccacacnntcnnnannnccnnngacntncgcactgtccatccantgcgtcaaccngccancgccnatcngtgnggtgacaacaacggcggatgctcncacatttgccnnatnggtgccggtggcnagaanttctcatgcgcatgccctgaccaattctacctgttgccaaanggncaagantgtgaagcnaattgcacgggncgncagttcncatgcantggcaccgactcnaagtgcattcccgcgacntgggaatgcganggggacaacgattgcgnggatgggtctgatgagcngggnnncgcnnattgcgnttaccaagcctgccaggccgannacttccaatgcnacaaccgcaantgcatgccgcacaattgnagctgcgatggctacgacgantgcggngatggctcggangagcagnactgcgaccacaactgccccgcgggcnagtaccactgccccaacaccgggcantgcatcccccngcngnaantntgcgatggcgacnacgattgtggggacggaactgacgagaatnagtcnnnctgcnagcacngcgacnancactgcgcngntgacaagttccnctgcaacaaccacaaatgcattccccagcnntnnaattgcgatggggacgacgattgtggggatggctccgangagcgnccnnngtgccaanaccnggnctgccaggcnggcnanttcnagtgcanaaacaccnacagntgcattccgcannaattnanntgcgatggcgacgacgattgtggggacggctcggacgagnagcgntgcgnctgccacaantgccngcacgccggcgaattccnntgcgccaacaacngccattgcatcccccagaaatggcaatgcgatggcgacaacgattgcggggacgggtcngacgagnagcacganaattgcganggcacnaaccncccctgccccgncgagnagttccgctgcaacaacggcaantgcattccccagnngtagctttgcgatggcaacnacgactgcggggatggcaccgacgagnagcagtgcacgctgcgcaantgcgcggctgggaagttccaatgcgacaacggcacntgcattcccgagcactanatntgcgatgggcagaacgattgtgnngacgnatccgacgagncgcactgcgaggatnnncancngaacnantgccccgccgacganttccaatgcgccaacagccantgcattccccgcaaatgnanntgcgatggggacaacgattgtggggacggctcggacgaggagnacgacaattgcaacgacnaaanctgccagccngangacnaattccgctgcgccaatacccgcaaatgcattcccnagnggtagcnntgcgatggcnacnacgattgcggggangangattgntccgatgagcannnnnanntntgcnanancnnnncgcaacaccncaactgccccgccgacnagttccaatgcgacaacgncaagtgcattcccncgacgtggatttgcgatggcgaagacgattgtggggatggntcngacgagaannngtgcnncaagcnnnacgacaagtgntnngncgatcagttcnncaacngcaaatgnancaagcatttgngnnnnnnngnnnnnganggnnacnantgnnannnnnnnnncgnnnnnnnnccnnancnnngnnnnccnntcnantgcnnngacnnnnncnnntgnnnnngnnncnnnnnntgcanncanntgnnnannnannnnnanggcnnnnacnnntgnnannnngnnnncgacnannannnnggcgttgtgatcggcgcaatgacgggcaaagactgccgggccaacggagagcccgccctcgtcatggtggccgccaatgacaagattctgcagctgaacatggttggcccccgtgggcgggtgaatgccgccgccagggcggccaacaaggagagtgacattggcgcggttgagttcgacccgaggcgggaactgatgttctgggtggacaccttccagaagcgggtgttccgctccgcattgccaaagggcaaccaatcggtaatgggcccgaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaggaggcgaatgagtgaaccttcgaggcaagacgacacgggcattgtgtacgtgaccacatcggatgggagatacaggaaaaagataatttcgggtcgtctccaaatcccaactgccatcgtaacattgccaaaacttggccgaatttgctacgccgacgctggcctggaagccaaaattgagtgcgcggatatggacggaaacaaacggcaaaccatcatctctgaactgatctactcgcccaccagcatggctgttgatgaaggacgngancancgnatctactgggcngannnnaannnncnnannnttgantctnnnnnnnncgatggcacnnnncgnttgnncntcnnnngcnnnnnnnnnnnancnnnnncnntngacntntnnganaannnnctntactngnnnnnnnnnnnnncnnannnnntntncnnnnngnacaanttcnnnngnannnnnnnnnannnnntggcnnnngnncnnnngnnnnnnnnnncnntnngnatncagcaaagnttcgcccgtgacatgctccgtgccgagagttcctgtgccaaagcccaatgctcccacctctgcgtggaactgccctctnnnggtttccgctgcatgtgccccgacaatgtcaccgaattcgaggatggctcctgcgggtcggcacgcattgaggagttggcaatgccaaagcagtgtgggtgccagaatgccggccattgtttggcggatggcagctgcgagtgtggggaattctttgagggcgaattctgccagaaagcctcctcagtgagccggcaactcattggcagacttggtcggttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 360 - DNA, 1293 bp, Artificial Sequence
  Description of Artificial Sequence: Synthetic polynucleotide
  modified_base (1)..(63): a, c, t, g, unknown or other
  modified_base (209)..(209): a, c, t, g, unknown or other
  modified_base (211)..(211): a, c, t, g, unknown or other
  modified_base (214)..(217): a, c, t, g, unknown or other
  modified_base (219)..(220): a, c, t, g, unknown or other
  modified_base (225)..(225): a, c, t, g, unknown or other
  modified_base (487)..(1182): a, c, t, g, unknown or other
  modified_base (1291)..(1293): a, c, t, g, unknown or other
nnnnnnnnnnnnnnnnnnnnnnnnnnnnnnnnnnnnnnnnnnnnnnnnnnnnnnnnnnnnnnnctcgatccggaaatcctgcaaatgtcgaccgagcaaatccgcgaacgcaccatgctgcttgacaacgagatccgcattatgcgcagcgaagtccagcgcatcaatcacaatgtccagacgctgaaggagaaagtgaaggagaacancnaannnntnnaggtnaacaaacaactcccctacctggtctcaaacgtcatcgagctgctcgaccttgaggaacaggccgaagaggagggcgccaacttcgacctggacgcgcacaaaaccaaatgcgccgtcatcaaaacctccacccgggccacctacttcctgcccgtcatcggcctggtcgaccacaacgagctgaagccgggcgacctggtcggtgtgaacaaggactcgtacctgatcctggagaagttaccgcccgagtacgactcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatgatcgcactccgccgcgactcgaccatcgtgaagcacgaggacttcatggacgccatcctggaggtgcaagccaagaagaaggccaccctgaactattacgctnnn

SEQ ID NO: 361 - DNA, 1530 bp, Artificial Sequence
  Description of Artificial Sequence: Synthetic polynucleotide
  modified_base (1)..(51): a, c, t, g, unknown or other
  modified_base (220)..(220): a, c, t, g, unknown or other
  modified_base (222)..(223): a, c, t, g, unknown or other
  modified_base (226)..(226): a, c, t, g, unknown or other
  modified_base (228)..(228): a, c, t, g, unknown or other
  modified_base (232)..(233): a, c, t, g, unknown or other
  modified_base (235)..(235): a, c, t, g, unknown or other
  modified_base (237)..(237): a, c, t, g, unknown or other
  modified_base (240)..(240): a, c, t, g, unknown or other
  modified_base (242)..(243): a, c, t, g, unknown or other
  modified_base (246)..(247): a, c, t, g, unknown or other
  modified_base (249)..(249): a, c, t, g, unknown or other
  modified_base (254)..(255): a, c, t, g, unknown or other
  modified_base (257)..(265): a, c, t, g, unknown or other
  modified_base (267)..(267): a, c, t, g, unknown or other
  modified_base (270)..(271): a, c, t, g, unknown or other
  modified_base (274)..(275): a, c, t, g, unknown or other
  modified_base (277)..(277): a, c, t, g, unknown or other
  modified_base (279)..(279): a, c, t, g, unknown or other
  modified_base (283)..(285): a, c, t, g, unknown or other
  modified_base (287)..(287): a, c, t, g, unknown or other
  modified_base (290)..(291): a, c, t, g, unknown or other
  modified_base (294)..(295): a, c, t, g, unknown or other
  modified_base (297)..(301): a, c, t, g, unknown or other
  modified_base (304)..(309): a, c, t, g, unknown or other
  modified_base (311)..(311): a, c, t, g, unknown or other
  modified_base (313)..(316): a, c, t, g, unknown or other
  modified_base (318)..(318): a, c, t, g, unknown or other
  modified_base (322)..(326): a, c, t, g, unknown or other
  modified_base (330)..(330): a, c, t, g, unknown or other
  modified_base (336)..(337): a, c, t, g, unknown or other
  modified_base (342)..(342): a, c, t, g, unknown or other
  modified_base (348)..(348): a, c, t, g, unknown or other
  modified_base (351)..(351): a, c, t, g, unknown or other
  modified_base (354)..(355): a, c, t, g, unknown or other
  modified_base (357)..(357): a, c, t, g, unknown or other
  modified_base (359)..(359): a, c, t, g, unknown or other
  modified_base (363)..(364): a, c, t, g, unknown or other
  modified_base (376)..(378): a, c, t, g, unknown or other
  modified_base (384)..(384): a, c, t, g, unknown or other
  modified_base (387)..(387): a, c, t, g, unknown or other
  modified_base (391)..(391): a, c, t, g, unknown or other
  modified_base (394)..(394): a, c, t, g, unknown or other
  modified_base (396)..(398): a, c, t, g, unknown or other
  modified_base (400)..(400): a, c, t, g, unknown or other
  modified_base (402)..(402): a, c, t, g, unknown or other
  modified_base (406)..(406): a, c, t, g, unknown or other
  modified_base (408)..(408): a, c, t, g, unknown or other
  modified_base (410)..(411): a, c, t, g, unknown or other
  modified_base (413)..(414): a, c, t, g, unknown or other
  modified_base (416)..(416): a, c, t, g, unknown or other
  modified_base (496)..(498): a, c, t, g, unknown or other
  modified_base (504)..(504): a, c, t, g, unknown or other
  modified_base (512)..(514): a, c, t, g, unknown or other
  modified_base (516)..(516): a, c, t, g, unknown or other
  modified_base (519)..(520): a, c, t, g, unknown or other
  modified_base (523)..(523): a, c, t, g, unknown or other
  modified_base (525)..(529): a, c, t, g, unknown or other
  modified_base (532)..(534): a, c, t, g, unknown or other
  modified_base (536)..(541): a, c, t, g, unknown or other
  modified_base (543)..(545): a, c, t, g, unknown or other
  modified_base (548)..(553): a, c, t, g, unknown or other
  modified_base (556)..(557): a, c, t, g, unknown or other
  modified_base (560)..(561): a, c, t, g, unknown or other
  modified_base (563)..(563): a, c, t, g, unknown or other
  modified_base (566)..(566): a, c, t, g, unknown or other
  modified_base (570)..(572): a, c, t, g, unknown or other
  modified_base (576)..(580): a, c, t, g, unknown or other
  modified_base (582)..(582): a, c, t, g, unknown or other
  modified_base (584)..(585): a, c, t, g, unknown or other
  modified_base (588)..(588): a, c, t, g, unknown or other
  modified_base (591)..(592): a, c, t, g, unknown or other
  modified_base (594)..(599): a, c, t, g, unknown or other
  modified_base (603)..(603): a, c, t, g, unknown or other
  modified_base (607)..(610): a, c, t, g, unknown or other
  modified_base (616)..(616): a, c, t, g, unknown or other
  modified_base (618)..(619): a, c, t, g, unknown or other
  modified_base (621)..(621): a, c, t, g, unknown or other
  modified_base (625)..(626): a, c, t, g, unknown or other
  modified_base (629)..(629): a, c, t, g, unknown or other
  modified_base (631)..(633): a, c, t, g, unknown or other
  modified_base (636)..(637): a, c, t, g, unknown or other
  modified_base (640)..(645): a, c, t, g, unknown or other
  modified_base (648)..(649): a, c, t, g, unknown or other
  modified_base (651)..(651): a, c, t, g, unknown or other
  modified_base (657)..(657): a, c, t, g, unknown or other
  modified_base (660)..(660): a, c, t, g, unknown or other
  modified_base (663)..(663): a, c, t, g, unknown or other
  modified_base (666)..(666): a, c, t, g, unknown or other
  modified_base (675)..(676): a, c, t, g, unknown or other
  modified_base (678)..(678): a, c, t, g, unknown or other
  modified_base (680)..(683): a, c, t, g, unknown or other
  modified_base (685)..(685): a, c, t, g, unknown or other
  modified_base (687)..(687): a, c, t, g, unknown or other
  modified_base (690)..(694): a, c, t, g, unknown or other
  modified_base (696)..(696): a, c, t, g, unknown or other
  modified_base (702)..(703): a, c, t, g, unknown or other
  modified_base (711)..(712): a, c, t, g, unknown or other
  modified_base (714)..(715): a, c, t, g, unknown or other
  modified_base (717)..(717): a, c, t, g, unknown or other
  modified_base (720)..(720): a, c, t, g, unknown or other
  modified_base (729)..(733): a, c, t, g, unknown or other
  modified_base (735)..(738): a, c, t, g, unknown or other
  modified_base (740)..(740): a, c, t, g, unknown or other
  modified_base (744)..(745): a, c, t, g, unknown or other
  modified_base (747)..(748): a, c, t, g, unknown or other
  modified_base (753)..(753): a, c, t, g, unknown or other
  modified_base (756)..(756): a, c, t, g, unknown or other
  modified_base (759)..(759): a, c, t, g, unknown or other
  modified_base (763)..(764): a, c, t, g, unknown or other
  modified_base (768)..(768): a, c, t, g, unknown or other
  modified_base (771)..(771): a, c, t, g, unknown or other
  modified_base (833)..(836): a, c, t, g, unknown or other
  modified_base (838)..(844): a, c, t, g, unknown or other
  modified_base (846)..(848): a, c, t, g, unknown or other
  modified_base (850)..(851): a, c, t, g, unknown or other
  modified_base (853)..(860): a, c, t, g, unknown or other
  modified_base (862)..(862): a, c, t, g, unknown or other
  modified_base (865)..(868): a, c, t, g, unknown or other
  modified_base (871)..(875): a, c, t, g, unknown or other
  modified_base (877)..(877): a, c, t, g, unknown or other
  modified_base (879)..(879): a, c, t, g, unknown or other
  modified_base (882)..(883): a, c, t, g, unknown or other
  modified_base (886)..(887): a, c, t, g, unknown or other
  modified_base (892)..(892): a, c, t, g, unknown or other
  modified_base (894)..(894): a, c, t, g, unknown or other
  modified_base (896)..(896): a, c, t, g, unknown or other
  modified_base (898)..(902): a, c, t, g, unknown or other
  modified_base (904)..(905): a, c, t, g, unknown or other
  modified_base (907)..(910): a, c, t, g, unknown or other
  modified_base (912)..(912): a, c, t, g, unknown or other
  modified_base (915)..(915): a, c, t, g, unknown or other
  modified_base (917)..(917): a, c, t, g, unknown or other
  modified_base (919)..(919): a, c, t, g, unknown or other
  modified_base (921)..(924): a, c, t, g, unknown or other
  modified_base (926)..(927): a, c, t, g, unknown or other
  modified_base (929)..(929): a, c, t, g, unknown or other
  modified_base (932)..(932): a, c, t, g, unknown or other
  modified_base (936)..(937): a, c, t, g, unknown or other
  modified_base (939)..(939): a, c, t, g, unknown or other
  modified_base (942)..(944): a, c, t, g, unknown or other
  modified_base (947)..(948): a, c, t, g, unknown or other
  modified_base (952)..(954): a, c, t, g, unknown or other
  modified_base (978)..(978): a, c, t, g, unknown or other
  modified_base (1027)..(1029): a, c, t, g, unknown or other
  modified_base (1155)..(1155): a, c, t, g, unknown or other
  modified_base (1500)..(1500): a, c, t, g, unknown or other
  modified_base (1528)..(1530): a, c, t, g, unknown or other
nnnnnnnnnnnnnnnnnnnnnnnnnnnnnnnnnnnnnnnnnnnnnnnnnnncagagttccgaggaatggaagtcgtccacgaagagggagacgtacactttgttggagcaagagttgggcaggctgctggcgacggcaccggccgagaagaaggactattggtacaaggagttcgaaaacttcaaggcccttttcgcccgctttctgcgcgccaagacancnnttnantggnncnanatncnnccnntncccgnngnnnnnnnnntnccnnatnngnanttgnnncnggnngannannnnnagnnnnnnangnnnntnctgnnnnngctngtggtnntcaanctgaanggnggnntngncacnnccatgggctgcnnnggcccnaantcgntgntnnngntncgcnangnncnnantttcctcgactttgcccttggccagcacaaaattttgaatgggaaatatggtgcagatgttccactgttgttgatgaacnnnttcaanacggatgnnnanacnnagnannnnntgnnnannnnnncnnntgnnnnnnttnnggnncnctncttnnnccannnnngntnnccncgnntnnnnnncgantccnnnntgccantnncncggnnttngnnnganngtnnnnnnganngntggtanccnccnggncatggcaanntntnnnncncnttnnnnnanagtggnntgctggannanntnctngcccagggnnnnnannnngntttnntnncgaanatnganaacnngggngcnacggttgacccgaacatcctcaactacatggccgccaggggggtccgagttcatcatggagnnnncnnnnnnnannngnncnnnnnnnnanggnnnnacnnnnngngnggnncanngattnantncnnnnncnntnnnntnctncngnannnngnncnagngccnncngannntgnngatnnnttcaaatcggtcagcaagttcagnatattcaacaccaacaacctctgggcaagtttggacgctgtcaagcggnnngtggtggccagcgagttggacatggaagtgatcgtcaacccaaagcatctggaccgtggcgttgatgtcatccagctggaaacggccgccggggctgccatcaagtgcttcaagggggcttgcgcnatcaatgtgcctcgttcccgctttctgccagtgaagaaaacctccgacttgctgcttctgatgagcaacctgtacgacatcgagaatggctatgtcacgctgagctcgttgcgttccttcccgaccacccctttggtcaagttgggcagctcctttgacagagtcaaagagttcctgaagcgcttccaaggcatcccggatttgctggagctggaccatttgacggtgtcgggtgacgtttggtttggcagggatgtgacactgaagggcactgtcatcataattgccaaccacggggatcgcattgacattccccccggcacaatcctcgaaaacaaaattgantcaggcaatctgcgcatacttgaccatnnn

SEQ ID NO: 362 - DNA, 849 bp, Artificial Sequence
  Description of Artificial Sequence: Synthetic polynucleotide
  modified_base (1)..(6): a, c, t, g, unknown or other
  modified_base (367)..(441): a, c, t, g, unknown or other
  modified_base (489)..(489): a, c, t, g, unknown or other
  modified_base (526)..(528): a, c, t, g, unknown or other
  modified_base (649)..(717): a, c, t, g, unknown or other
  modified_base (745)..(747): a, c, t, g, unknown or other
  modified_base (847)..(849): a, c, t, g, unknown or other
nnnnnnaagctaagcgacgcagagaaggtgcgaattgcttctgactttctgctacaatcgccacccggcgaattcaatgaggtttttaacgatgtgcgtactctgctgaatgatgagcagctgctggagaaaggctgcttggaggcggtcaagcagtacaacaaagcgcaatttgtgcccgtgaaggtggagggtgccgagcaaccgactttgatcacggagttcaatgaactacccgatggacaatttgtggacccaaagtcgcggaaagcgttcaaatacgaccatttgcgcaaagaggcggccgatgtgcaaccggggccaaaggaagacgagaagcaggaggcttggcgaaaagctttgcaannnnnnnnnnnnnnnnnnnnnnnnnnnnnnnnnnnnnnnnnnnnnnnnnnnnnnnnnnnnnnnnnnnnnnnnnnnctggtgctgtgcattgagtcccatcagtttcagccgaagaactactgnaacggccgctggcgctcggaatggcatttgcccgctnnngacggcaaagcgaccctgcacaaatgcacgggcaaattgcgtctccaagtgcactactacgaggacggcaatgtgcagttgatctcggagaaggagctcgcggtggacgtcaaactcacannnnnnnnnnnnnnnnnnnnnnnnnnnnnnnnnnnnnnnnnnnnnnnnnnnnnnnnnnnnnnnnnnnnngcaatccaggagagccaatcttccatgnnngaaagcaccttcaagacgttgcgccgtcagctgcccgtgacacgctccaagctggactggcaaaagtgtcacagctaccggatcactcaggacatgaagnnn

SEQ ID NO: 363 - DNA, 1413 bp, Artificial Sequence
  Description of Artificial Sequence: Synthetic polynucleotide
  modified_base (1)..(219): a, c, t, g, unknown or other
  modified_base (478)..(1413): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcactcgtccaaagaccggaaacgccctacccctgttcgttgtgctcctcacggtttggctccaagatggagttggaggagcatcagaactcgcacaccggccaaaagccgttccaatgcgatgtgtgccaatcgcggttcaaccgccgctcaactctgtggaatcacaaacggatacacagcgacgcgaagccattcgtttgcaccgtttgccatatgcaattcaagtggaagaactcgctgaagtgccacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 364 - DNA, 1146 bp, Artificial Sequence
  Description of Artificial Sequence: Synthetic polynucleotide
  modified_base (1)..(180): a, c, t, g, unknown or other
  modified_base (546)..(546): a, c, t, g, unknown or other
  modified_base (933)..(933): a, c, t, g, unknown or other
  modified_base (1035)..(1035): a, c, t, g, unknown or other
  modified_base (1041)..(1041): a, c, t, g, unknown or other
  modified_base (1071)..(1071): a, c, t, g, unknown or other
  modified_base (1144)..(1146): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgaaccattgttgcgcgagaatcccaaccgatttgtgatgttccccatcaagtaccacgacatttggcagtactacaagaaggcggtcgcctcattttggactgttgaagaggtggacttggccaaggatgttggcgactggctgaaactcaccgacccagagcgcttcttcatctcacgcgtgctcgctttctttgccgcgtcggatgggattgtcaacgaaaatttggtagaacgctttgcccaagaggtccaagtgcccgaagcgcgttgcttctacggcttccagatcgccattgagaacatccactctgagatgtactccaagctgatcgagacctacgtgaaggacactgaagagagngacaaacttttcaacgccattttcgagttcgagttcatcaagaagaaggcggactgggccctccgttggattgccagcaaggaggccaccttcggggagcgcatcattgcgtttgccgccgtggagggcatcttcttctcgggcagctttgccgccatcttttggctgaagaagcgcggcctcatgcccggattgacgcacagcaacgagttgatctcgcgcgatgagggattgcaccgggattttgcatgtcttctcttccagcatctcaacaagaagcccagtgagcagcgaatccaggagatcatccgggaggcggtcaccattgagaaggaatatttgaccgatgccctgcctgtggacatgatcgggatgaattgccgtgtnatgagccagtacattgagttcattgccgaccatcttcttgtggagcttggctatgagaagatctacaaggtgcacaacccgttcgacttcatggacaacctntccatngagggcaagaccaacttcttcgagaagaangtgtccgagtaccagaagatgggcgtcatctccaccgaggccgagcgcgagttccgtctggacgctgactttnnn

SEQ ID NO: 365 - DNA, 408 bp, Artificial Sequence
  Description of Artificial Sequence: Synthetic polynucleotide
  modified_base (24)..(24): a, c, t, g, unknown or other
  modified_base (36)..(36): a, c, t, g, unknown or other
  modified_base (48)..(48): a, c, t, g, unknown or other
  modified_base (109)..(111): a, c, t, g, unknown or other
  modified_base (400)..(408): a, c, t, g, unknown or other
atgatctaccaaaaatacgttganattggccgcgtngtgttcatcgcnaagggcaaggaccagggcaagctggcggtgattgtgaacgtcattgatggcaacaaggttnnnctcgacggcccgtcctccggcgttcgccgcggtgtctggaacttcaaggacttgcaactgaccaaattcaagttgccactgcgtgtcggccaacgcaccaagggcgtgcagaaagcctacgaggaggccgagatcaacaagaagtgggacgacaccgagtgggccaagcggattgctcggaagaagctgcgcgacaacctgaacgacttcgaacgcttcaaggtgttcaaggccaaacagcaccggaaccggctggtccgcgtcgagatgggcaaactgaagaaggcgnnnnnnnnn

SEQ ID NO: 366 - DNA, 1431 bp, Artificial Sequence
  Description of Artificial Sequence: Synthetic polynucleotide
  modified_base (219)..(219): a, c, t, g, unknown or other
  modified_base (435)..(435): a, c, t, g, unknown or other
  modified_base (519)..(519): a, c, t, g, unknown or other
  modified_base (882)..(882): a, c, t, g, unknown or other
  modified_base (978)..(978): a, c, t, g, unknown or other
  modified_base (1080)..(1080): a, c, t, g, unknown or other
  modified_base (1291)..(1431): a, c, t, g, unknown or other
atggaccacgaggcgctaatcgaggagctgcccaccatcgagaagttggacccgcgggagcggatagcgctggcccgggaacggcgtgccctgcagcttcggaccaacctggaccgcgaggcacaattgccgccaccggcacagcgtcgtccccggcttcggttcagtccggatgttgcgttgctggaggccacagtgaggggagattcgcaagaattngaacggcttttgatggaaggcgtcaacccggattcccacaacgaagacggactcacccctttgcatcagtgcgccattgacaacaacgaacgcattgtccgccttctgctcaggtacggcgccaacgtgaacgccaaagacacggagcagtggacgcctttgcacgctgccgcctgttgtggatacatcgagattgtgcgccttctcattgactancatgccgatttgttggccgtaaatgccgatggcaatatgccatatgacatttgtgatgatgaacaaacacttgacttgattgantccgaaatggcagcccgtggcattacccaggaaatgatcgacgaccgccgccaacagcctgaacgccaaatgctgaacgacatgaagttgttgcaccagaaggactgcccctggatcagcgcaatccccgacaaatccacatttctccacattgcggcagccaatggctactacgacgtggcggcattcctgctccgttgcggagtgtcgcccgctttgcgtgacattgatctctggcatccaatccatgcggcagcttcttggaatcagccggacattattgaattgctgagtgaatatggggctgacatcaatgccaagacgggtgccggtgaaacgccattaggtttgcttttgaaattngatccgcacaatttgccaaacagaagcccggcggaaacgcggacccggcggaggcggcattttggagtgcgcgactcgcggaggcaaagcagaganaggaagaagttcgagtcgccgcagcaagcagcagccaatctggaaaatccattctccgcgcgaggtgccattcgtaggcaatcgcttagagatcgcagctgnatgacactcgcccgacttgaggcccaacgcgaaggttccgatctgatccgaagctggagcaaagaggacgtgtccaacatggcacacctgcaacaacgccgagactcacccccaaaacgagtgctggctggcggacgttctgcaggcggcacccaacaaaagcagaagcaaatgacaccggacgagtggctgaagaagttggaagcggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 367 - DNA, 381 bp, Artificial Sequence
  Description of Artificial Sequence: Synthetic polynucleotide
  modified_base (78)..(78): a, c, t, g, unknown or other
  modified_base (81)..(81): a, c, t, g, unknown or other
  modified_base (84)..(84): a, c, t, g, unknown or other
  modified_base (93)..(93): a, c, t, g, unknown or other
  modified_base (185)..(185): a, c, t, g, unknown or other
  modified_base (265)..(381): a, c, t, g, unknown or other
atgaagctggtccgtttcctgatgaaactttcgcacgagaccgtcaccatcgagctgaagaatggcacccaagtgacnggnacnatccagggngtcgacgtggccatgaacatgcacctgcgctccgtcaaaatgaccgtccgcggtcgtgagcaaatccaactggacacactctcaatccgagntaacaacattcgctacatccaactgccggactcgctgccgctcgacacactgctcattgacgacgagccgcgcaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 368 - DNA, 2103 bp, Artificial Sequence
  Description of Artificial Sequence: Synthetic polynucleotide
  modified_base (1)..(732): a, c, t, g, unknown or other
  modified_base (858)..(858): a, c, t, g, unknown or other
  modified_base (1108)..(1575): a, c, t, g, unknown or other
  modified_base (1596)..(1596): a, c, t, g, unknown or other
  modified_base (1605)..(1605): a, c, t, g, unknown or other
  modified_base (1620)..(1620): a, c, t, g, unknown or other
  modified_base (1635)..(1635): a, c, t, g, unknown or other
  modified_base (1655)..(1655): a, c, t, g, unknown or other
  modified_base (1660)..(1660): a, c, t, g, unknown or other
  modified_base (1664)..(1666): a, c, t, g, unknown or other
  modified_base (1668)..(1673): a, c, t, g, unknown or other
  modified_base (1731)..(1731): a, c, t, g, unknown or other
  modified_base (1735)..(1902): a, c, t, g, unknown or other
  modified_base (2098)..(2103): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatttaggcactgctagttattacgcgtccatgaccatcagggcgcgtgatcccgatgccaaagtgcttattataactggcgaggaagaatctccttatcgaagagcgcctctctccaaaganctttggtggtatggggatgagcaaagtgcgtccacactctcttacagtcccacaacagaaaagagaaaacaccttctttacgaggcagacggtttctatttggattctgaaaaacttgacaattgggaacatggtggaattgctttgatgtgtggcgtcaaagttggcaaaatagacagcgagaacaattttatacaactgcaagatgggcgcaaaattgattatggaaaatgccttattgctacaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatggcggagtgttagcngatgctttnttgggtgtgaaacanaatttatgggctgcnggtgatatttgttcattttntgatnaaannntnnnnnnaaggcgttgcacacattggcaacatgcacaaataacgggacgaattgccggcgaaaanatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgctgttgttttctacacgcatcctaataccagccagatttgtggtgttttattatacaatgtgtatggattcgccgaggagatggctcggaagctgatccaggataaagaaccaattaagaagattaaggaatatgcaaaattatttgaactttgggatcctgtggaagaagagaagaatgaagtgagaagcnnnnnn

SEQ ID NO: 369 - DNA, 1242 bp, Artificial Sequence
  Description of Artificial Sequence: Synthetic polynucleotide
  modified_base (1)..(654): a, c, t, g, unknown or other
  modified_base (1083)..(1083): a, c, t, g, unknown or other
  modified_base (1240)..(1242): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgccaaaaccactccaaactggtggtggttggccttcaatccaagctggcttccatcagcaaaacgttcaaaaatgtgctggaaattcggacagaaaacctgaagttgaagcgggcgcggagggagaagttcagcaaatccgccgcaatcccctcaaatctgccgccttcggccagcactgggaacagtcagtttaactttgttgacgacatggcagcgagtggctcctcatcagttgcattggacatggaccgacttgaacagcatcgcatacaggaacaggccaccttgattgacgaaacggacacgtaccaccagtcgcggtacagcgctatggaaagcattgagagcagcatttccgagctgggcaccattttccggcaattggcctcgctggtttcggaacagggcgagatgatcacaagnattgactcaaacattgaggagaccgccatcaatgtggaggcggcccaccatgaattgctcagatatttcaacaacatttcccgcaaccgttggctcataatcaaggtgttcggcgtgctgatggccttcttcatattcttcgtcatattcatgacannn

SEQ ID NO: 370 - DNA, 1878 bp, Artificial Sequence
  Description of Artificial Sequence: Synthetic polynucleotide
  modified_base (67)..(69): a, c, t, g, unknown or other
  modified_base (154)..(156): a, c, t, g, unknown or other
  modified_base (214)..(933): a, c, t, g, unknown or other
  modified_base (1035)..(1035): a, c, t, g, unknown or other
  modified_base (1159)..(1159): a, c, t, g, unknown or other
  modified_base (1161)..(1162): a, c, t, g, unknown or other
  modified_base (1164)..(1165): a, c, t, g, unknown or other
  modified_base (1248)..(1248): a, c, t, g, unknown or other
  modified_base (1488)..(1488): a, c, t, g, unknown or other
  modified_base (1524)..(1524): a, c, t, g, unknown or other
  modified_base (1530)..(1530): a, c, t, g, unknown or other
  modified_base (1809)..(1812): a, c, t, g, unknown or other
  modified_base (1814)..(1816): a, c, t, g, unknown or other
  modified_base (1873)..(1878): a, c, t, g, unknown or other
atgattgaattattctcgatctttggcaagggaggcctcgtattgtggtgcttcaatgaaggttccnnnaattttcttaattcaaccgtgaatgactttgttcggaatgcgataatacatgaacgaagcataaattcatatacgcatgagggcnnncatacaatcaaatacaagctggacaatgaattcgaactgatcattttggtactgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggctggttttccgcgttcaaatctctggtcggaaccaaacaactaaacaaagaagaaatcgaaccggttctagagaaaatgcgtgaagtgctcataccnaaaaatgttgcttttgaacccgcgcaaaaaatttgtgaatctgttggaacaaagcttgagggcaaggtgatcggaacattcaaccgagtcacatcaattgtacgagagtcaatgcgtgaagcantnntnnagttgcttaccccgaagcgtcgcgtcgacattctccgtgacataattgatgcaaaagcaaacagccgtccatatgtcattgtnttttgtggcgtgaatggagttggcaagtcgacaaatctggcaaaaataacattctggctgaacgaaaacgggcataaagtgctgatcgctgccggtgacacatttcgagctggtgctgtcgaacagcttcgtacgcatgcccaccatttgaatgcacttcactcacagggtgtgcaattatttgagcaaggctatgggaaggatccagcatcaattgcacaagcggctattcaattggcnaaagagcggaaatttgatgttgttttggtggacacngccggncgaatgcaagacaatgagccactgatgagggctttgagcaaactgatcattgtgaacaaccctgaccttgttctctttgttggcgaagcgctggtcgggaatgaagccgtcgatcaactggtcaaattcaatcaggcacttgctgaccattccgctgtgggggataaagcacggctcattgatggcattgtgctcaccaagtttgacacaatcgacgacaaggtcggagccgcaatttcaatgaccttcatcactggccagccgattgtatttgtcggnnnngnnnaaacttacaatgatttgcgcagtcttaacgtgaatgccgtggtgaacagtcttctgnnnnnn

SEQ ID NO: 371 - DNA, 402 bp, Artificial Sequence
  Description of Artificial Sequence: Synthetic polynucleotide
  modified_base (1)..(33): a, c, t, g, unknown or other
  modified_base (90)..(90): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (156)..(156): a, c, t, g, unknown or other
  modified_base (159)..(159): a, c, t, g, unknown or other
  modified_base (165)..(165): a, c, t, g, unknown or other
  modified_base (174)..(174): a, c, t, g, unknown or other
  modified_base (202)..(285): a, c, t, g, unknown or other
  modified_base (394)..(402): a, c, t, g, unknown or other
nnnnnnnnnnnnnnnnnnnnnnnnnnnnnnnnncaggccttcgtgcaacactactacagcaagtttgatgtgcccgatccgcaggcccgntgcacngggctnaccgatgtntacgatccggagcactcgttcatgaccttcgaaggcaaccaggtncanggccgnctggcaatnctcgagaagtttgcggtgagtggatttnnnnnnnnnnnnnnnnnnnnnnnnnnnnnnnnnnnnnnnnnnnnnnnnnnnnnnnnnnnnnnnnnnnnnnnnnnnnnnnnnnnncagacggacgacgacccggtcaactcgttcaaccactgcttcattctgcggcccaacggcaacggctccttctacatttccaacgagattttccgtctggttctgcacnnnnnnnnn

SEQ ID NO: 372 - DNA, 1938 bp, Artificial Sequence
  Description of Artificial Sequence: Synthetic polynucleotide
  modified_base (1)..(888): a, c, t, g, unknown or other
  modified_base (938)..(939): a, c, t, g, unknown or other
  modified_base (941)..(941): a, c, t, g, unknown or other
  modified_base (946)..(949): a, c, t, g, unknown or other
  modified_base (960)..(961): a, c, t, g, unknown or other
  modified_base (963)..(963): a, c, t, g, unknown or other
  modified_base (973)..(975): a, c, t, g, unknown or other
  modified_base (981)..(981): a, c, t, g, unknown or other
  modified_base (984)..(987): a, c, t, g, unknown or other
  modified_base (989)..(990): a, c, t, g, unknown or other
  modified_base (997)..(998): a, c, t, g, unknown or other
  modified_base (1001)..(1001): a, c, t, g, unknown or other
  modified_base (1004)..(1004): a, c, t, g, unknown or other
  modified_base (1009)..(1011): a, c, t, g, unknown or other
  modified_base (1207)..(1938): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaacaaagggcctccccagaagcgtcagtacacatcaacaagcaaganntnctgcnnnntttgcaacaannangtgtgcaacnnntacttnctnnnnanncacatgnncanaangcatnnnattgtgattgatgagaacaaagtggtcattgccaacattgacacggccgagaaggagcgcaaaggcgaggtgaagttccgctgcgagatttgcacggccagcatgaccacgcgggaacagttgcgcgcacacaaacgcgaaatgcacgggatggcgccaattggccgctgcacacgccgccctcaaaaacgatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 373 - DNA, 945 bp, Artificial Sequence
  Description of Artificial Sequence: Synthetic polynucleotide
  modified_base (1)..(72): a, c, t, g, unknown or other
  modified_base (198)..(198): a, c, t, g, unknown or other
  modified_base (397)..(399): a, c, t, g, unknown or other
  modified_base (882)..(882): a, c, t, g, unknown or other
  modified_base (943)..(945): a, c, t, g, unknown or other
nnnnnnnnnnnnnnnnnnnnnnnnnnnnnnnnnnnnnnnnnnnnnnnnnnnnnnnnnnnnnnnnnnnnnnnnaaaaacaaccaaaattagggcggagccgagcatgatgctaaattcgatcatgaggcattcttgggcaaggatgaggccaaacaattcgatgaactgacacccgaaaagagcaaagaacggctggcnaaattggtgccaaaaatggacctaaactcggatggtctcattgaagagaatgaactcagggagcatattaattttatgcagaaacgatatgtgaacaacgatgttgaacgcacttggaagaactacaaggaagagcaagtgcaagatggcaaactcggttggcaagattaccgcgatttggtctatgggaagccacaannngaggggcaggaggttgcacccgaataccagcgtatgattgagcgggatgagcgtcgttggaaggtggctgactatgattcagacgggaagctggacaggacagaatacggctgttttatgcatcccgaagactgtgaccacatgcgcgatattgttgttcaagaaacagtggaagacattgacaaagacaaggatggctttgttgacttgcaggaatacattggtgacatgtatcgaccggatgattacccggaactgaatggaaaggagccggaatgggtggaatccgagcgagaaatgttccgcgagcacagggacaaagacagggatggaaaattgaacaaagatgaaatgcgcgattgggtgatgcccttgaactttgaccatgccgatgccgaggccaagcatctgatccacattgcggatgacgataaggatgggaaattgtcactcgaggaagtccttgcccactacgacacattngttggctcacaagccaccgactatggcgaacagcttcaaaagcacgatccagccgatctannn

SEQ ID NO: 374 - DNA, 1440 bp, Artificial Sequence
  Description of Artificial Sequence: Synthetic polynucleotide
  modified_base (1)..(63): a, c, t, g, unknown or other
  modified_base (175)..(175): a, c, t, g, unknown or other
  modified_base (198)..(199): a, c, t, g, unknown or other
  modified_base (201)..(201): a, c, t, g, unknown or other
  modified_base (1023)..(1023): a, c, t, g, unknown or other
  modified_base (1158)..(1158): a, c, t, g, unknown or other
  modified_base (1167)..(1167): a, c, t, g, unknown or other
  modified_base (1221)..(1221): a, c, t, g, unknown or other
  modified_base (1402)..(1440): a, c, t, g, unknown or other
nnnnnnnnnnnnnnnnnnnnnnnnnnnnnnnnnnnnnnnnnnnnnnnnnnnnnnnnnnnnnnnattctgggaagaacattttccgccactgctgcagaagccaaaaaaccaccggagaaaacaagttttggtgggctgaaagacgatgataggattttcacaaatctctatggcnggcatgattatcgactgaaagcnncnatgtccaggggcgactggtacaaaacaaaggaaatcatcttgaaaggtgccaaatggatcctcaacgaggtcagcgtttctggactgcgtggacggggaggtgccggtttcccgagcggcatgaaatggggctttatgagcaaaccattcgatggacgacccaaatatttggtggtgaatgcggacgagggcgagcccgggacttgcaaagatcgggaaatcatgcgccatgatccgcacaaattggttgaaggctgcttgattgcgggcgtggcaatgggcgctcgagcggcttacatttacattcggggcgaattctacaacgaggcatgcattttgcaagaggcaatccatgaagcgtacaaggccggatttcttggcaaagattgcttcggcacgggctataatttcgatgtttttgttcaccgaggtgccggcgcttacatttgtggggaagagacggcactaattgaatcgattgagggcaaacagggaaagccacggctgaaacctccatttcccgcggatgttggcgtttttggatgtccaacgacggttacaaatgtggaaacggtggctgttgcgccaacaatttgtcgcagaggaggcagttggtttgcgggatttggacgagagcgaaacagagggacacagttgttctgcatttctggccatgtgaacgatccaacaacggtggaagaggaaatgtccatcccccttcgtgatttgattgaacgccatgccggcggagtcattggcggatgggacaacttgttgggcattatccccggtggatcttcagttccagttctgccaaagagnatttgcgacaatgtgctcatggactttgacgcgctggtccaagtgaactccggtctgggcacggctgctgtgattgtcatgaacaagcagtgcgacattgtgaagtgtattgcccggctcagcatgttctacaancacgaatcntgtggacagtgcacaccttgtcgagaaggatgcaattggctgaacaaaataatntggcgtttcgtgcaaggaaaagcagtgccatcggaaattgacatgatttgggaactcaccaagcagattgaagggcacacgatttgtgcgttgggtgacgctgcggcatggcctgttcagggattgatacggcacttcagaccggaattggagagaagaatggccgaatatgcgaaaaaannnnnnnnnnnnnnnnnnnnnnnnnnnnnnnnnnnnnnn

SEQ ID NO: 375 - DNA, 666 bp, Artificial Sequence
  Description of Artificial Sequence: Synthetic polynucleotide
  modified_base (15)..(15): a, c, t, g, unknown or other
  modified_base (18)..(18): a, c, t, g, unknown or other
  modified_base (54)..(54): a, c, t, g, unknown or other
  modified_base (135)..(135): a, c, t, g, unknown or other
  modified_base (153)..(153): a, c, t, g, unknown or other
  modified_base (243)..(243): a, c, t, g, unknown or other
  modified_base (381)..(382): a, c, t, g, unknown or other
  modified_base (384)..(384): a, c, t, g, unknown or other
  modified_base (393)..(393): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (420)..(420): a, c, t, g, unknown or other
  modified_base (423)..(423): a, c, t, g, unknown or other
  modified_base (426)..(426): a, c, t, g, unknown or other
  modified_base (430)..(430): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (447)..(450): a, c, t, g, unknown or other
  modified_base (453)..(454): a, c, t, g, unknown or other
  modified_base (456)..(456): a, c, t, g, unknown or other
  modified_base (460)..(460): a, c, t, g, unknown or other
  modified_base (465)..(466): a, c, t, g, unknown or other
  modified_base (471)..(473): a, c, t, g, unknown or other
  modified_base (481)..(481): a, c, t, g, unknown or other
  modified_base (483)..(486): a, c, t, g, unknown or other
  modified_base (493)..(493): a, c, t, g, unknown or other
  modified_base (495)..(495): a, c, t, g, unknown or other
  modified_base (498)..(498): a, c, t, g, unknown or other
  modified_base (501)..(502): a, c, t, g, unknown or other
  modified_base (506)..(507): a, c, t, g, unknown or other
  modified_base (512)..(512): a, c, t, g, unknown or other
  modified_base (520)..(520): a, c, t, g, unknown or other
  modified_base (522)..(522): a, c, t, g, unknown or other
  modified_base (525)..(526): a, c, t, g, unknown or other
  modified_base (528)..(528): a, c, t, g, unknown or other
  modified_base (532)..(532): a, c, t, g, unknown or other
  modified_base (542)..(548): a, c, t, g, unknown or other
  modified_base (550)..(554): a, c, t, g, unknown or other
  modified_base (557)..(558): a, c, t, g, unknown or other
  modified_base (560)..(564): a, c, t, g, unknown or other
  modified_base (566)..(566): a, c, t, g, unknown or other
  modified_base (568)..(574): a, c, t, g, unknown or other
  modified_base (577)..(577): a, c, t, g, unknown or other
  modified_base (579)..(581): a, c, t, g, unknown or other
  modified_base (583)..(585): a, c, t, g, unknown or other
  modified_base (588)..(591): a, c, t, g, unknown or other
  modified_base (593)..(596): a, c, t, g, unknown or other
  modified_base (599)..(607): a, c, t, g, unknown or other
  modified_base (609)..(609): a, c, t, g, unknown or other
  modified_base (612)..(613): a, c, t, g, unknown or other
  modified_base (615)..(615): a, c, t, g, unknown or other
  modified_base (619)..(619): a, c, t, g, unknown or other
  modified_base (621)..(622): a, c, t, g, unknown or other
  modified_base (627)..(627): a, c, t, g, unknown or other
  modified_base (630)..(630): a, c, t, g, unknown or other
  modified_base (633)..(633): a, c, t, g, unknown or other
  modified_base (636)..(636): a, c, t, g, unknown or other
  modified_base (642)..(643): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
  modified_base (660)..(660): a, c, t, g, unknown or other
  modified_base (663)..(666): a, c, t, g, unknown or other
atgggactgtttggnaanatttttggcggaaagagcggcaaaccggaaccaacnacacaagaagcgttgcaaaccctgggcaataccgaagagttgcttctaaagaaacaggaatacctgaacaagcaaatcganacgtcactggcaacagcnaagaaacatgccgcctctaacaagaaggtggcacttaaggcactgaagcaaaagaaattgtacgagaaacaacttcaagacaccgagggnattttgaacaccattcatcaccagaaaagctcgctcgaaaatgctgctcttcatgctgaagtccttcaagtgatgacgggcaccagtaaggcgatgaaatcggcacaaaagggaatggatgtggagaaggttcatganntnatggaaganatngcngancaacaagaagtttcaaanganatnacanangcnatnagcaatccnnnnggnntncaanacgannttgannnggacgagntnnnnaaggagntnganganntggnngaggncgaattgnangannanttgntggatgttgnnnnnnnannnnngannannnnngncnnnnnnnaancnnncnnngannnncnnnnagnnnnnnnnncnaanncnaagnannaaganganganctngctganntggangcntgggcnaangcnnnn

SEQ ID NO: 376 - DNA, 13353 bp, Artificial Sequence
  Description of Artificial Sequence: Synthetic polynucleotide
  modified_base (1)..(105): a, c, t, g, unknown or other
  modified_base (178)..(189): a, c, t, g, unknown or other
  modified_base (193)..(193): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (207)..(207): a, c, t, g, unknown or other
  modified_base (209)..(209): a, c, t, g, unknown or other
  modified_base (217)..(220): a, c, t, g, unknown or other
  modified_base (224)..(225): a, c, t, g, unknown or other
  modified_base (229)..(229): a, c, t, g, unknown or other
  modified_base (231)..(238): a, c, t, g, unknown or other
  modified_base (240)..(247): a, c, t, g, unknown or other
  modified_base (249)..(249): a, c, t, g, unknown or other
  modified_base (252)..(252): a, c, t, g, unknown or other
  modified_base (254)..(254): a, c, t, g, unknown or other
  modified_base (256)..(256): a, c, t, g, unknown or other
  modified_base (258)..(260): a, c, t, g, unknown or other
  modified_base (262)..(266): a, c, t, g, unknown or other
  modified_base (268)..(269): a, c, t, g, unknown or other
  modified_base (271)..(273): a, c, t, g, unknown or other
  modified_base (276)..(279): a, c, t, g, unknown or other
  modified_base (281)..(281): a, c, t, g, unknown or other
  modified_base (283)..(286): a, c, t, g, unknown or other
  modified_base (288)..(288): a, c, t, g, unknown or other
  modified_base (291)..(295): a, c, t, g, unknown or other
  modified_base (303)..(305): a, c, t, g, unknown or other
  modified_base (308)..(310): a, c, t, g, unknown or other
  modified_base (313)..(319): a, c, t, g, unknown or other
  modified_base (321)..(321): a, c, t, g, unknown or other
  modified_base (324)..(325): a, c, t, g, unknown or other
  modified_base (327)..(330): a, c, t, g, unknown or other
  modified_base (334)..(334): a, c, t, g, unknown or other
  modified_base (337)..(343): a, c, t, g, unknown or other
  modified_base (345)..(347): a, c, t, g, unknown or other
  modified_base (349)..(349): a, c, t, g, unknown or other
  modified_base (352)..(356): a, c, t, g, unknown or other
  modified_base (359)..(359): a, c, t, g, unknown or other
  modified_base (361)..(362): a, c, t, g, unknown or other
  modified_base (365)..(366): a, c, t, g, unknown or other
  modified_base (369)..(369): a, c, t, g, unknown or other
  modified_base (373)..(373): a, c, t, g, unknown or other
  modified_base (375)..(375): a, c, t, g, unknown or other
  modified_base (378)..(378): a, c, t, g, unknown or other
  modified_base (380)..(381): a, c, t, g, unknown or other
  modified_base (383)..(383): a, c, t, g, unknown or other
  modified_base (386)..(386): a, c, t, g, unknown or other
  modified_base (388)..(388): a, c, t, g, unknown or other
  modified_base (390)..(390): a, c, t, g, unknown or other
  modified_base (703)..(705): a, c, t, g, unknown or other
  modified_base (936)..(936): a, c, t, g, unknown or other
  modified_base (1198)..(1200): a, c, t, g, unknown or other
  modified_base (1288)..(1686): a, c, t, g, unknown or other
  modified_base (1782)..(1782): a, c, t, g, unknown or other
  modified_base (2422)..(2589): a, c, t, g, unknown or other
  modified_base (2712)..(2712): a, c, t, g, unknown or other
  modified_base (2847)..(2847): a, c, t, g, unknown or other
  modified_base (3789)..(3789): a, c, t, g, unknown or other
  modified_base (3792)..(3792): a, c, t, g, unknown or other
  modified_base (3794)..(3795): a, c, t, g, unknown or other
  modified_base (3798)..(3805): a, c, t, g, unknown or other
  modified_base (3809)..(3810): a, c, t, g, unknown or other
  modified_base (3812)..(3813): a, c, t, g, unknown or other
  modified_base (3815)..(3816): a, c, t, g, unknown or other
  modified_base (3818)..(3822): a, c, t, g, unknown or other
  modified_base (3824)..(3826): a, c, t, g, unknown or other
  modified_base (3828)..(3831): a, c, t, g, unknown or other
  modified_base (3834)..(3834): a, c, t, g, unknown or other
  modified_base (3837)..(3837): a, c, t, g, unknown or other
  modified_base (3840)..(3840): a, c, t, g, unknown or other
  modified_base (3843)..(3849): a, c, t, g, unknown or other
  modified_base (3852)..(3852): a, c, t, g, unknown or other
  modified_base (3856)..(3872): a, c, t, g, unknown or other
  modified_base (3874)..(3874): a, c, t, g, unknown or other
  modified_base (3880)..(3881): a, c, t, g, unknown or other
  modified_base (3884)..(3884): a, c, t, g, unknown or other
  modified_base (3886)..(3889): a, c, t, g, unknown or other
  modified_base (3891)..(3891): a, c, t, g, unknown or other
  modified_base (3894)..(3894): a, c, t, g, unknown or other
  modified_base (3897)..(3898): a, c, t, g, unknown or other
  modified_base (3904)..(3906): a, c, t, g, unknown or other
  modified_base (3909)..(3909): a, c, t, g, unknown or other
  modified_base (3912)..(3915): a, c, t, g, unknown or other
  modified_base (3919)..(3919): a, c, t, g, unknown or other
  modified_base (3921)..(3922): a, c, t, g, unknown or other
  modified_base (3924)..(3930): a, c, t, g, unknown or other
  modified_base (3934)..(3934): a, c, t, g, unknown or other
  modified_base (3936)..(3937): a, c, t, g, unknown or other
  modified_base (3942)..(3949): a, c, t, g, unknown or other
  modified_base (3951)..(3951): a, c, t, g, unknown or other
  modified_base (3955)..(3956): a, c, t, g, unknown or other
  modified_base (3963)..(3963): a, c, t, g, unknown or other
  modified_base (3968)..(3970): a, c, t, g, unknown or other
  modified_base (3972)..(3973): a, c, t, g, unknown or other
  modified_base (3977)..(3979): a, c, t, g, unknown or other
  modified_base (3986)..(3986): a, c, t, g, unknown or other
  modified_base (3993)..(3995): a, c, t, g, unknown or other
  modified_base (3997)..(3997): a, c, t, g, unknown or other
  modified_base (4000)..(4002): a, c, t, g, unknown or other
  modified_base (4006)..(4008): a, c, t, g, unknown or other
  modified_base (4011)..(4013): a, c, t, g, unknown or other
  modified_base (4018)..(4019): a, c, t, g, unknown or other
  modified_base (4023)..(4025): a, c, t, g, unknown or other
  modified_base (4030)..(4031): a, c, t, g, unknown or other
  modified_base (4033)..(4034): a, c, t, g, unknown or other
  modified_base (4037)..(4046): a, c, t, g, unknown or other
  modified_base (4050)..(4050): a, c, t, g, unknown or other
  modified_base (4052)..(4052): a, c, t, g, unknown or other
  modified_base (4056)..(4063): a, c, t, g, unknown or other
  modified_base (4066)..(4069): a, c, t, g, unknown or other
  modified_base (4074)..(4077): a, c, t, g, unknown or other
  modified_base (4079)..(4084): a, c, t, g, unknown or other
  modified_base (4086)..(4087): a, c, t, g, unknown or other
  modified_base (4089)..(4091): a, c, t, g, unknown or other
  modified_base (4096)..(4098): a, c, t, g, unknown or other
  modified_base (4101)..(4102): a, c, t, g, unknown or other
  modified_base (4107)..(4109): a, c, t, g, unknown or other
  modified_base (4113)..(4115): a, c, t, g, unknown or other
  modified_base (4120)..(4121): a, c, t, g, unknown or other
  modified_base (4125)..(4126): a, c, t, g, unknown or other
  modified_base (4128)..(4128): a, c, t, g, unknown or other
  modified_base (4133)..(4134): a, c, t, g, unknown or other
  modified_base (4137)..(4143): a, c, t, g, unknown or other
  modified_base (4145)..(4146): a, c, t, g, unknown or other
  modified_base (4148)..(4153): a, c, t, g, unknown or other
  modified_base (4155)..(4170): a, c, t, g, unknown or other
  modified_base (4175)..(4176): a, c, t, g, unknown or other
  modified_base (4179)..(4179): a, c, t, g, unknown or other
  modified_base (4182)..(4183): a, c, t, g, unknown or other
  modified_base (4185)..(4190): a, c, t, g, unknown or other
  modified_base (4194)..(4194): a, c, t, g, unknown or other
  modified_base (4199)..(4199): a, c, t, g, unknown or other
  modified_base (4201)..(4201): a, c, t, g, unknown or other
  modified_base (4207)..(4208): a, c, t, g, unknown or other
  modified_base (4210)..(4210): a, c, t, g, unknown or other
  modified_base (4215)..(4215): a, c, t, g, unknown or other
  modified_base (4218)..(4218): a, c, t, g, unknown or other
  modified_base (4224)..(4233): a, c, t, g, unknown or other
  modified_base (4236)..(4239): a, c, t, g, unknown or other
  modified_base (4241)..(4245): a, c, t, g, unknown or other
  modified_base (4247)..(4249): a, c, t, g, unknown or other
  modified_base (4251)..(4252): a, c, t, g, unknown or other
  modified_base (4254)..(4254): a, c, t, g, unknown or other
  modified_base (4258)..(4258): a, c, t, g, unknown or other
  modified_base (4260)..(4261): a, c, t, g, unknown or other
  modified_base (4266)..(4269): a, c, t, g, unknown or other
  modified_base (4273)..(4273): a, c, t, g, unknown or other
  modified_base (4276)..(4276): a, c, t, g, unknown or other
  modified_base (4278)..(4281): a, c, t, g, unknown or other
  modified_base (4290)..(4290): a, c, t, g, unknown or other
  modified_base (4295)..(4295): a, c, t, g, unknown or other
  modified_base (4297)..(4297): a, c, t, g, unknown or other
  modified_base (4299)..(4299): a, c, t, g, unknown or other
  modified_base (4329)..(4329): a, c, t, g, unknown or other
  modified_base (4510)..(4515): a, c, t, g, unknown or other
  modified_base (4648)..(4926): a, c, t, g, unknown or other
  modified_base (5152)..(5154): a, c, t, g, unknown or other
  modified_base (5269)..(5269): a, c, t, g, unknown or other
  modified_base (5272)..(5272): a, c, t, g, unknown or other
  modified_base (5274)..(5275): a, c, t, g, unknown or other
  modified_base (5282)..(5282): a, c, t, g, unknown or other
  modified_base (5306)..(5306): a, c, t, g, unknown or other
  modified_base (5310)..(5310): a, c, t, g, unknown or other
  modified_base (5317)..(5317): a, c, t, g, unknown or other
  modified_base (5319)..(5320): a, c, t, g, unknown or other
  modified_base (5323)..(5323): a, c, t, g, unknown or other
  modified_base (5331)..(5331): a, c, t, g, unknown or other
  modified_base (5335)..(5335): a, c, t, g, unknown or other
  modified_base (5337)..(5337): a, c, t, g, unknown or other
  modified_base (5345)..(5345): a, c, t, g, unknown or other
  modified_base (5356)..(5356): a, c, t, g, unknown or other
  modified_base (5361)..(5361): a, c, t, g, unknown or other
  modified_base (5367)..(5367): a, c, t, g, unknown or other
  modified_base (5378)..(5378): a, c, t, g, unknown or other
  modified_base (5382)..(5383): a, c, t, g, unknown or other
  modified_base (5397)..(5398): a, c, t, g, unknown or other
  modified_base (5420)..(5420): a, c, t, g, unknown or other
  modified_base (5425)..(5425): a, c, t, g, unknown or other
  modified_base (5441)..(5441): a, c, t, g, unknown or other
  modified_base (5445)..(5445): a, c, t, g, unknown or other
  modified_base (5452)..(5452): a, c, t, g, unknown or other
  modified_base (5460)..(5461): a, c, t, g, unknown or other
  modified_base (5464)..(5464): a, c, t, g, unknown or other
  modified_base (5472)..(5472): a, c, t, g, unknown or other
  modified_base (5475)..(5475): a, c, t, g, unknown or other
  modified_base (5480)..(5480): a, c, t, g, unknown or other
  modified_base (5484)..(5484): a, c, t, g, unknown or other
  modified_base (5498)..(5498): a, c, t, g, unknown or other
  modified_base (5504)..(5504): a, c, t, g, unknown or other
  modified_base (5520)..(5520): a, c, t, g, unknown or other
  modified_base (5523)..(5523): a, c, t, g, unknown or other
  modified_base (5528)..(5528): a, c, t, g, unknown or other
  modified_base (5536)..(5536): a, c, t, g, unknown or other
  modified_base (5538)..(5539): a, c, t, g, unknown or other
  modified_base (5541)..(5541): a, c, t, g, unknown or other
  modified_base (5550)..(5551): a, c, t, g, unknown or other
  modified_base (5555)..(5556): a, c, t, g, unknown or other
  modified_base (5560)..(5560): a, c, t, g, unknown or other
  modified_base (5562)..(5562): a, c, t, g, unknown or other
  modified_base (5564)..(5565): a, c, t, g, unknown or other
  modified_base (5568)..(5571): a, c, t, g, unknown or other
  modified_base (5574)..(5574): a, c, t, g, unknown or other
  modified_base (5577)..(5577): a, c, t, g, unknown or other
  modified_base (5579)..(5581): a, c, t, g, unknown or other
  modified_base (5583)..(5587): a, c, t, g, unknown or other
  modified_base (5590)..(5592): a, c, t, g, unknown or other
  modified_base (5598)..(5598): a, c, t, g, unknown or other
  modified_base (6045)..(6045): a, c, t, g, unknown or other
  modified_base (6047)..(6048): a, c, t, g, unknown or other
  modified_base (6050)..(6051): a, c, t, g, unknown or other
  modified_base (6053)..(6054): a, c, t, g, unknown or other
  modified_base (6057)..(6060): a, c, t, g, unknown or other
  modified_base (6063)..(6064): a, c, t, g, unknown or other
  modified_base (6066)..(6066): a, c, t, g, unknown or other
  modified_base (6068)..(6070): a, c, t, g, unknown or other
  modified_base (6072)..(6073): a, c, t, g, unknown or other
  modified_base (6077)..(6078): a, c, t, g, unknown or other
  modified_base (6080)..(6099): a, c, t, g, unknown or other
  modified_base (6102)..(6102): a, c, t, g, unknown or other
  modified_base (6104)..(6105): a, c, t, g, unknown or other
  modified_base (6109)..(6109): a, c, t, g, unknown or other
  modified_base (6111)..(6115): a, c, t, g, unknown or other
  modified_base (6117)..(6117): a, c, t, g, unknown or other
  modified_base (6120)..(6120): a, c, t, g, unknown or other
  modified_base (6124)..(6125): a, c, t, g, unknown or other
  modified_base (6128)..(6129): a, c, t, g, unknown or other
  modified_base (6132)..(6132): a, c, t, g, unknown or other
  modified_base (6135)..(6135): a, c, t, g, unknown or other
  modified_base (6140)..(6141): a, c, t, g, unknown or other
  modified_base (6149)..(6149): a, c, t, g, unknown or other
  modified_base (6156)..(6156): a, c, t, g, unknown or other
  modified_base (6162)..(6163): a, c, t, g, unknown or other
  modified_base (6165)..(6165): a, c, t, g, unknown or other
  modified_base (6172)..(6172): a, c, t, g, unknown or other
  modified_base (6174)..(6174): a, c, t, g, unknown or other
  modified_base (6177)..(6179): a, c, t, g, unknown or other
  modified_base (6181)..(6181): a, c, t, g, unknown or other
  modified_base (6183)..(6183): a, c, t, g, unknown or other
  modified_base (6185)..(6187): a, c, t, g, unknown or other
  modified_base (6190)..(6195): a, c, t, g, unknown or other
  modified_base (6197)..(6198): a, c, t, g, unknown or other
  modified_base (6200)..(6201): a, c, t, g, unknown or other
  modified_base (6203)..(6206): a, c, t, g, unknown or other
  modified_base (6208)..(6208): a, c, t, g, unknown or other
  modified_base (6210)..(6211): a, c, t, g, unknown or other
  modified_base (6213)..(6214): a, c, t, g, unknown or other
  modified_base (6217)..(6219): a, c, t, g, unknown or other
  modified_base (6222)..(6223): a, c, t, g, unknown or other
  modified_base (6225)..(6226): a, c, t, g, unknown or other
  modified_base (6228)..(6229): a, c, t, g, unknown or other
  modified_base (6232)..(6232): a, c, t, g, unknown or other
  modified_base (6234)..(6234): a, c, t, g, unknown or other
  modified_base (6237)..(6237): a, c, t, g, unknown or other
  modified_base (6239)..(6240): a, c, t, g, unknown or other
  modified_base (6246)..(6246): a, c, t, g, unknown or other
  modified_base (6249)..(6249): a, c, t, g, unknown or other
  modified_base (6255)..(6256): a, c, t, g, unknown or other
  modified_base (6258)..(6258): a, c, t, g, unknown or other
  modified_base (6262)..(6266): a, c, t, g, unknown or other
  modified_base (6270)..(6270): a, c, t, g, unknown or other
  modified_base (6273)..(6274): a, c, t, g, unknown or other
  modified_base (6276)..(6276): a, c, t, g, unknown or other
  modified_base (6278)..(6282): a, c, t, g, unknown or other
  modified_base (6286)..(6286): a, c, t, g, unknown or other
  modified_base (6288)..(6291): a, c, t, g, unknown or other
  modified_base (6296)..(6297): a, c, t, g, unknown or other
  modified_base (6300)..(6300): a, c, t, g, unknown or other
  modified_base (6304)..(6305): a, c, t, g, unknown or other
  modified_base (6307)..(6307): a, c, t, g, unknown or other
  modified_base (6309)..(6309): a, c, t, g, unknown or other
  modified_base (6313)..(6313): a, c, t, g, unknown or other
  modified_base (6315)..(6316): a, c, t, g, unknown or other
  modified_base (6318)..(6322): a, c, t, g, unknown or other
  modified_base (6324)..(6327): a, c, t, g, unknown or other
  modified_base (6330)..(6332): a, c, t, g, unknown or other
  modified_base (6334)..(6336): a, c, t, g, unknown or other
  modified_base (6339)..(6339): a, c, t, g, unknown or other
  modified_base (6393)..(6393): a, c, t, g, unknown or other
  modified_base (6643)..(6783): a, c, t, g, unknown or other
  modified_base (6815)..(6822): a, c, t, g, unknown or other
  modified_base (6824)..(6824): a, c, t, g, unknown or other
  modified_base (6831)..(6833): a, c, t, g, unknown or other
  modified_base (6835)..(6836): a, c, t, g, unknown or other
  modified_base (6839)..(6844): a, c, t, g, unknown or other
  modified_base (6846)..(6846): a, c, t, g, unknown or other
  modified_base (6850)..(6850): a, c, t, g, unknown or other
  modified_base (6853)..(6853): a, c, t, g, unknown or other
  modified_base (6855)..(6855): a, c, t, g, unknown or other
  modified_base (6864)..(6867): a, c, t, g, unknown or other
  modified_base (6870)..(6870): a, c, t, g, unknown or other
  modified_base (6872)..(6873): a, c, t, g, unknown or other
  modified_base (6876)..(6877): a, c, t, g, unknown or other
  modified_base (6883)..(6886): a, c, t, g, unknown or other
  modified_base (6889)..(6892): a, c, t, g, unknown or other
  modified_base (6895)..(6898): a, c, t, g, unknown or other
  modified_base (6900)..(6900): a, c, t, g, unknown or other
  modified_base (6902)..(6902): a, c, t, g, unknown or other
  modified_base (6904)..(6910): a, c, t, g, unknown or other
  modified_base (6912)..(6913): a, c, t, g, unknown or other
  modified_base (6915)..(6919): a, c, t, g, unknown or other
  modified_base (6921)..(6921): a, c, t, g, unknown or other
  modified_base (6926)..(6928): a, c, t, g, unknown or other
  modified_base (6930)..(6933): a, c, t, g, unknown or other
  modified_base (6935)..(6935): a, c, t, g, unknown or other
  modified_base (6937)..(6937): a, c, t, g, unknown or other
  modified_base (6939)..(6940): a, c, t, g, unknown or other
  modified_base (6942)..(6945): a, c, t, g, unknown or other
  modified_base (6948)..(6948): a, c, t, g, unknown or other
  modified_base (6951)..(6951): a, c, t, g, unknown or other
  modified_base (6954)..(6959): a, c, t, g, unknown or other
  modified_base (6961)..(6961): a, c, t, g, unknown or other
  modified_base (6963)..(6963): a, c, t, g, unknown or other
  modified_base (6967)..(6973): a, c, t, g, unknown or other
  modified_base (6975)..(6975): a, c, t, g, unknown or other
  modified_base (6978)..(6980): a, c, t, g, unknown or other
  modified_base (6984)..(6988): a, c, t, g, unknown or other
  modified_base (6990)..(6996): a, c, t, g, unknown or other
  modified_base (6999)..(7000): a, c, t, g, unknown or other
  modified_base (7005)..(7009): a, c, t, g, unknown or other
  modified_base (7011)..(7012): a, c, t, g, unknown or other
  modified_base (7014)..(7016): a, c, t, g, unknown or other
  modified_base (7018)..(7018): a, c, t, g, unknown or other
  modified_base (7020)..(7020): a, c, t, g, unknown or other
  modified_base (7022)..(7023): a, c, t, g, unknown or other
  modified_base (7027)..(7028): a, c, t, g, unknown or other
  modified_base (7039)..(7040): a, c, t, g, unknown or other
  modified_base (7042)..(7042): a, c, t, g, unknown or other
  modified_base (7044)..(7057): a, c, t, g, unknown or other
  modified_base (7059)..(7061): a, c, t, g, unknown or other
  modified_base (7064)..(7064): a, c, t, g, unknown or other
  modified_base (7066)..(7066): a, c, t, g, unknown or other
  modified_base (7071)..(7071): a, c, t, g, unknown or other
  modified_base (7075)..(7076): a, c, t, g, unknown or other
  modified_base (7078)..(7078): a, c, t, g, unknown or other
  modified_base (7080)..(7082): a, c, t, g, unknown or other
  modified_base (7084)..(7089): a, c, t, g, unknown or other
  modified_base (7091)..(7092): a, c, t, g, unknown or other
  modified_base (7095)..(7095): a, c, t, g, unknown or other
  modified_base (7102)..(7103): a, c, t, g, unknown or other
  modified_base (7105)..(7105): a, c, t, g, unknown or other
  modified_base (7108)..(7109): a, c, t, g, unknown or other
  modified_base (7111)..(7111): a, c, t, g, unknown or other
  modified_base (7114)..(7118): a, c, t, g, unknown or other
  modified_base (7120)..(7120): a, c, t, g, unknown or other
  modified_base (7122)..(7122): a, c, t, g, unknown or other
  modified_base (7124)..(7129): a, c, t, g, unknown or other
  modified_base (7134)..(7134): a, c, t, g, unknown or other
  modified_base (7137)..(7137): a, c, t, g, unknown or other
  modified_base (7140)..(7142): a, c, t, g, unknown or other
  modified_base (7145)..(7146): a, c, t, g, unknown or other
  modified_base (7150)..(7153): a, c, t, g, unknown or other
  modified_base (7155)..(7159): a, c, t, g, unknown or other
  modified_base (7162)..(7163): a, c, t, g, unknown or other
  modified_base (7167)..(7167): a, c, t, g, unknown or other
  modified_base (7171)..(7174): a, c, t, g, unknown or other
  modified_base (7176)..(7177): a, c, t, g, unknown or other
  modified_base (7181)..(7184): a, c, t, g, unknown or other
  modified_base (7186)..(7192): a, c, t, g, unknown or other
  modified_base (7194)..(7194): a, c, t, g, unknown or other
  modified_base (7197)..(7198): a, c, t, g, unknown or other
  modified_base (7201)..(7203): a, c, t, g, unknown or other
  modified_base (7210)..(7211): a, c, t, g, unknown or other
  modified_base (7213)..(7215): a, c, t, g, unknown or other
  modified_base (7217)..(7219): a, c, t, g, unknown or other
  modified_base (7221)..(7221): a, c, t, g, unknown or other
  modified_base (7223)..(7223): a, c, t, g, unknown or other
  modified_base (7225)..(7226): a, c, t, g, unknown or other
  modified_base (7230)..(7230): a, c, t, g, unknown or other
  modified_base (7232)..(7234): a, c, t, g, unknown or other
  modified_base (7236)..(7239): a, c, t, g, unknown or other
  modified_base (7247)..(7247): a, c, t, g, unknown or other
  modified_base (7250)..(7251): a, c, t, g, unknown or other
  modified_base (7253)..(7253): a, c, t, g, unknown or other
  modified_base (7256)..(7257): a, c, t, g, unknown or other
  modified_base (7261)..(7262): a, c, t, g, unknown or other
  modified_base (7266)..(7267): a, c, t, g, unknown or other
  modified_base (7272)..(7272): a, c, t, g, unknown or other
  modified_base (7275)..(7281): a, c, t, g, unknown or other
  modified_base (7284)..(7284): a, c, t, g, unknown or other
  modified_base (7288)..(7290): a, c, t, g, unknown or other
  modified_base (7293)..(7293): a, c, t, g, unknown or other
  modified_base (7296)..(7300): a, c, t, g, unknown or other
  modified_base (7303)..(7303): a, c, t, g, unknown or other
  modified_base (7305)..(7305): a, c, t, g, unknown or other
  modified_base (7308)..(7309): a, c, t, g, unknown or other
  modified_base (7311)..(7316): a, c, t, g, unknown or other
  modified_base (7319)..(7321): a, c, t, g, unknown or other
  modified_base (7329)..(7330): a, c, t, g, unknown or other
  modified_base (7334)..(7334): a, c, t, g, unknown or other
  modified_base (7339)..(7340): a, c, t, g, unknown or other
  modified_base (7343)..(7343): a, c, t, g, unknown or other
  modified_base (7346)..(7347): a, c, t, g, unknown or other
  modified_base (7349)..(7349): a, c, t, g, unknown or other
  modified_base (7353)..(7356): a, c, t, g, unknown or other
  modified_base (7359)..(7359): a, c, t, g, unknown or other
  modified_base (7363)..(7365): a, c, t, g, unknown or other
  modified_base (7369)..(7375): a, c, t, g, unknown or other
  modified_base (7377)..(7377): a, c, t, g, unknown or other
  modified_base (7379)..(7379): a, c, t, g, unknown or other
  modified_base (7381)..(7383): a, c, t, g, unknown or other
  modified_base (7386)..(7387): a, c, t, g, unknown or other
  modified_base (7389)..(7389): a, c, t, g, unknown or other
  modified_base (7391)..(7392): a, c, t, g, unknown or other
  modified_base (7396)..(7396): a, c, t, g, unknown or other
  modified_base (7398)..(7398): a, c, t, g, unknown or other
  modified_base (7400)..(7401): a, c, t, g, unknown or other
  modified_base (7404)..(7407): a, c, t, g, unknown or other
  modified_base (7410)..(7410): a, c, t, g, unknown or other
  modified_base (7413)..(7413): a, c, t, g, unknown or other
  modified_base (7415)..(7417): a, c, t, g, unknown or other
  modified_base (7419)..(7423): a, c, t, g, unknown or other
  modified_base (7426)..(7428): a, c, t, g, unknown or other
  modified_base (7434)..(7435): a, c, t, g, unknown or other
  modified_base (7439)..(7442): a, c, t, g, unknown or other
  modified_base (7444)..(7446): a, c, t, g, unknown or other
  modified_base (7449)..(7449): a, c, t, g, unknown or other
  modified_base (7453)..(7455): a, c, t, g, unknown or other
  modified_base (7459)..(7460): a, c, t, g, unknown or other
  modified_base (7464)..(7464): a, c, t, g, unknown or other
  modified_base (7466)..(7466): a, c, t, g, unknown or other
  modified_base (7470)..(7470): a, c, t, g, unknown or other
  modified_base (7472)..(7472): a, c, t, g, unknown or other
  modified_base (7476)..(7479): a, c, t, g, unknown or other
  modified_base (7483)..(7484): a, c, t, g, unknown or other
  modified_base (7492)..(7492): a, c, t, g, unknown or other
  modified_base (7494)..(7494): a, c, t, g, unknown or other
  modified_base (7498)..(7498): a, c, t, g, unknown or other
  modified_base (7500)..(7500): a, c, t, g, unknown or other
  modified_base (7502)..(7503): a, c, t, g, unknown or other
  modified_base (7508)..(7509): a, c, t, g, unknown or other
  modified_base (7512)..(7512): a, c, t, g, unknown or other
  modified_base (7516)..(7521): a, c, t, g, unknown or other
  modified_base (7524)..(7524): a, c, t, g, unknown or other
  modified_base (7528)..(7529): a, c, t, g, unknown or other
  modified_base (7534)..(7534): a, c, t, g, unknown or other
  modified_base (7537)..(7540): a, c, t, g, unknown or other
  modified_base (7542)..(7542): a, c, t, g, unknown or other
  modified_base (7545)..(7545): a, c, t, g, unknown or other
  modified_base (7547)..(7547): a, c, t, g, unknown or other
  modified_base (7551)..(7557): a, c, t, g, unknown or other
  modified_base (7560)..(7561): a, c, t, g, unknown or other
  modified_base (7563)..(7563): a, c, t, g, unknown or other
  modified_base (7566)..(7566): a, c, t, g, unknown or other
  modified_base (7569)..(7571): a, c, t, g, unknown or other
  modified_base (7575)..(7579): a, c, t, g, unknown or other
  modified_base (7581)..(7582): a, c, t, g, unknown or other
  modified_base (7586)..(7592): a, c, t, g, unknown or other
  modified_base (7596)..(7602): a, c, t, g, unknown or other
  modified_base (7605)..(7605): a, c, t, g, unknown or other
  modified_base (7609)..(7612): a, c, t, g, unknown or other
  modified_base (7614)..(7616): a, c, t, g, unknown or other
  modified_base (7619)..(7623): a, c, t, g, unknown or other
  modified_base (7627)..(7627): a, c, t, g, unknown or other
  modified_base (7632)..(7632): a, c, t, g, unknown or other
  modified_base (7635)..(7635): a, c, t, g, unknown or other
  modified_base (7640)..(7646): a, c, t, g, unknown or other
  modified_base (7649)..(7653): a, c, t, g, unknown or other
  modified_base (7656)..(7659): a, c, t, g, unknown or other
  modified_base (7666)..(7669): a, c, t, g, unknown or other
  modified_base (7671)..(7673): a, c, t, g, unknown or other
  modified_base (7677)..(7680): a, c, t, g, unknown or other
  modified_base (7683)..(7686): a, c, t, g, unknown or other
  modified_base (7863)..(7863): a, c, t, g, unknown or other
  modified_base (8157)..(8157): a, c, t, g, unknown or other
  modified_base (8481)..(8481): a, c, t, g, unknown or other
  modified_base (8617)..(8619): a, c, t, g, unknown or other
  modified_base (8799)..(8799): a, c, t, g, unknown or other
  modified_base (9388)..(9389): a, c, t, g, unknown or other
  modified_base (9391)..(9391): a, c, t, g, unknown or other
  modified_base (9395)..(9395): a, c, t, g, unknown or other
  modified_base (9397)..(9399): a, c, t, g, unknown or other
  modified_base (9401)..(9411): a, c, t, g, unknown or other
  modified_base (9415)..(9416): a, c, t, g, unknown or other
  modified_base (9418)..(9418): a, c, t, g, unknown or other
  modified_base (9420)..(9420): a, c, t, g, unknown or other
  modified_base (9425)..(9425): a, c, t, g, unknown or other
  modified_base (9429)..(9429): a, c, t, g, unknown or other
  modified_base (9431)..(9432): a, c, t, g, unknown or other
  modified_base (9434)..(9434): a, c, t, g, unknown or other
  modified_base (9436)..(9436): a, c, t, g, unknown or other
  modified_base (9441)..(9441): a, c, t, g, unknown or other
  modified_base (9443)..(9445): a, c, t, g, unknown or other
  modified_base (9447)..(9448): a, c, t, g, unknown or other
  modified_base (9450)..(9450): a, c, t, g, unknown or other
  modified_base (9452)..(9452): a, c, t, g, unknown or other
  modified_base (9454)..(9454): a, c, t, g, unknown or other
  modified_base (9457)..(9464): a, c, t, g, unknown or other
  modified_base (9466)..(9468): a, c, t, g, unknown or other
  modified_base (9471)..(9477): a, c, t, g, unknown or other
  modified_base (9481)..(9481): a, c, t, g, unknown or other
  modified_base (9486)..(9489): a, c, t, g, unknown or other
  modified_base (9498)..(9501): a, c, t, g, unknown or other
  modified_base (9504)..(9504): a, c, t, g, unknown or other
  modified_base (9507)..(9507): a, c, t, g, unknown or other
  modified_base (9509)..(9509): a, c, t, g, unknown or other
  modified_base (9511)..(9511): a, c, t, g, unknown or other
  modified_base (9515)..(9517): a, c, t, g, unknown or other
  modified_base (9523)..(9523): a, c, t, g, unknown or other
  modified_base (9525)..(9525): a, c, t, g, unknown or other
  modified_base (9529)..(9534): a, c, t, g, unknown or other
  modified_base (9537)..(9537): a, c, t, g, unknown or other
  modified_base (9540)..(9540): a, c, t, g, unknown or other
  modified_base (9546)..(9546): a, c, t, g, unknown or other
  modified_base (9549)..(9552): a, c, t, g, unknown or other
  modified_base (9556)..(9557): a, c, t, g, unknown or other
  modified_base (9561)..(9561): a, c, t, g, unknown or other
  modified_base (9564)..(9564): a, c, t, g, unknown or other
  modified_base (9568)..(9571): a, c, t, g, unknown or other
  modified_base (9574)..(9580): a, c, t, g, unknown or other
  modified_base (9582)..(9583): a, c, t, g, unknown or other
  modified_base (9587)..(9590): a, c, t, g, unknown or other
  modified_base (9593)..(9593): a, c, t, g, unknown or other
  modified_base (9595)..(9595): a, c, t, g, unknown or other
  modified_base (9597)..(9597): a, c, t, g, unknown or other
  modified_base (9599)..(9603): a, c, t, g, unknown or other
  modified_base (9607)..(9612): a, c, t, g, unknown or other
  modified_base (9615)..(9615): a, c, t, g, unknown or other
  modified_base (9617)..(9618): a, c, t, g, unknown or other
  modified_base (9620)..(9620): a, c, t, g, unknown or other
  modified_base (9622)..(9622): a, c, t, g, unknown or other
  modified_base (9625)..(9626): a, c, t, g, unknown or other
  modified_base (9630)..(9630): a, c, t, g, unknown or other
  modified_base (9717)..(9717): a, c, t, g, unknown or other
  modified_base (10356)..(10356): a, c, t, g, unknown or other
  modified_base (10560)..(10560): a, c, t, g, unknown or other
  modified_base (10587)..(10587): a, c, t, g, unknown or other
  modified_base (10590)..(10590): a, c, t, g, unknown or other
  modified_base (10617)..(10617): a, c, t, g, unknown or other
  modified_base (10636)..(10636): a, c, t, g, unknown or other
  modified_base (10663)..(10663): a, c, t, g, unknown or other
  modified_base (10677)..(10677): a, c, t, g, unknown or other
  modified_base (10701)..(10701): a, c, t, g, unknown or other
  modified_base (10719)..(10719): a, c, t, g, unknown or other
  modified_base (10780)..(10780): a, c, t, g, unknown or other
  modified_base (10784)..(10785): a, c, t, g, unknown or other
  modified_base (10788)..(10788): a, c, t, g, unknown or other
  modified_base (11278)..(11280): a, c, t, g, unknown or other
  modified_base (11679)..(11679): a, c, t, g, unknown or other
  modified_base (11800)..(12069): a, c, t, g, unknown or other
  modified_base (12469)..(12477): a, c, t, g, unknown or other
  modified_base (12627)..(12627): a, c, t, g, unknown or other
  modified_base (12805)..(12813): a, c, t, g, unknown or other
  modified_base (12982)..(13353): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagagccaccaccgaatctttgctgactgtcgagtgggagggcatccaaagcggagaccacccggattccnnnnnnnnnnnnttcnttgtngantancgngncgagaagnnnngccnntggnannnnnnnncnnnnnnnntnccntncnannncnnnnntnncnnntannnngncnnnntnccnnnnntgcccacnnncannnccnnnnnnntncgnntnnnngtgntgnnnnnnnannncnaannnnntgngnnaannccngaantncgngnncncancnanattgtcagcatcaaatgcgaaccggacgagatcactgccccgggggatgtggatgtaaaggagagggcacagttcagtgttgcacttgcttggcagccgcccgagtgcggctctgtgggcgaataccaaatcgagttgcgcggcctcgaccaacaattcgatgttcaccggcaaacagtggcacagccccaggccagcatcactggccttctgtccggaacagaatacgctgtccgaatccgtgccgttgaccgcgcacgcattgttggcccatggacggaggagctggtgactgttagcaccaagggcgaannnttgccggaacaaaccgaagccaccgtcgactatacaaccgaaactgaagcacgcttgagttggcccccattggaagaccagcggttgcagcactacgaggtggtactggccgagattgatgagcaacccgaacgtgtggaacgaatgcgacttggccccaatcagagcagcgcgcacttcagcgaattgaggcctgacactgagtacaaagtgggagtgctcgcctatttngaccacgaaccaaagcgactttaccggctctcgctgcgaaccggcacagagtcggccgttgaattggcccagaaaccagtggtgctgcaggatgctcagggggaatatgaaatccattggaaatcgcaacccgatttggccacagtcgaccgcttcattgttgagtaccggccagggaatgagacaaagtggcgactgacggagcagcaggcaattgcgggcaaggcacagagccattcggcaaaggcacccgaattgagannngacgccttctcggtgcgcgttttgtttgtggatggccaatccaaagtggtggcagccaccggcgagcaaattgttcgccaccgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgtaccgcctccggattgttttggcgccgccccggtcattccttgtctggactccgttggccgaacatcggcacagcatcaaccgattcaangtttcgcacagaccaaccgcacaatcggaatggacttctgtggatggcccgcccgaccaattcgcgtgtcccccaggattggctcaaccaaccgacttttgtttggacctgcaaggcttggatctgggccggcaatattcggccgaagtggtctaccagctggctggcggcaaatggagcccgaaaggaagtccgctctttttcatactggtccaagatgagtcatcggccgccaccaccggaggacctttgcaattccatcaagtccgggtggaacaagagggtgccaagtcagctgtgcattggaaagctgagggcccagccgttcaagtacgggcctaccaggtcgaagttcgttctggtgccgagcaagcttggcgaccggcaagtggatatgttggggcagaacggggccaacgggaattccgaacggaagtggacagcgccttgttggttggcaatgccgaagtgcgagtgcgtgccgttggggccgacgggaagccgatggcgttgagcaaaccgctggaagcgggaagcccttgcgaacgtgagaaatggaaacattcttttctttgtattattgccacattcagcgttgacaacgccgccaaacgaagtcagtctgagtcgagtggatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctttcagccgaggctgtccacaaacgcacacggcgcacaatttgcgacccacggacggattactggtgccggccggacttcagcgttgacgagcatgcggacggcattcggcacagacgncttgtctcgacccccaccgtgaccgcatccgatggctcactggaagtcagttggcgctcagaaggcgcaggccgtggcgttttcggctaccgagtattgtacaaaccgcccggtgccggttggaatccctacagncaaattgtgccctatgtcggcgatgacgaggagtacagccaagcgttggagggcctctcgccgggcgttgcctacgacttgcaaatccaagcccttgaccgcaactcctatgtgctctacacatctccagaagtgcgctccaccgcgcactgtttgccgccaatccagccgccagcccaactcacggttgatgcacccgacccgcggcatgtccgtgtcacttgggtgccgttgccagaaagtgcgtggcgttgcgccaaagctcaaattgaattgcaagttgacgatcctcgcggcaatgcgcccgttttgttggacgcccgacaaagcagtcacgtgtttgagtcggcccccgggcaacgctggactgtgcgtgcacgaacccggaacgaggctggccaatccgcatggtcgtcttctgtgtcggcagccaccctctcatctgccgagcccatcgatggcccgttcgtgtcctttgcccagggcgtgccccgactgagttggcgtggccgggaaggcgcctcggaattggttgaccattttgtggtggaatggcgccgccgcaccgagccccggtggaaccagctttcgcgcaaagtgcccttcaccgggtggcaacgaccgtacaacgccgaattggaccagttggcgcccggtcatgtgtatgaggtgcgagtaaaggctgtggaccacaacatgggcactgcgttccagtcgggcacggtcacggtgcagccccaggccctatgccaaccgccacgggcagcacccagaggagttcaaatcactccgctggggcccaaccaattgcgactcagttggcttcccctggtggagtcggaatggcaatgcgacagcatctggtacgtggtcaagtactccagcgacgaggaacaaggtttccgtaacttttcttccggcgacagcagcaccgtctttgantcncnnccnnnnnnnnaatnncnntnncnnnnncnnncnnnnaanccngcnggnnnnnnnccntggnnnnnnnnnnnnnnnnncnaaacannggncnnnncnccnggnnctgtcnnnganttnnnngccnanncnnnnnnncccnannccgtnnnnnnnncntggnngccaccncccgnnncnnacgnnnaaatcangggctannngntgnnntacnnnctnnnctccnntggnnngtgcnncnntgnnnnnnnnnngccnancacnnnnnnnnccnnnnagccnnnntnnnnnntnnannngctgnnnccnnactcnnnctannncattnncgtnncngcccnnacnnnnnnngnngnnnnnnannnnnnnnnnnnnnnngtgcnnacngannannnnnngccnacggnancgcccnncnatttncgngtggannnnnnnnnngannnnannnnngnnntnngntggnanncgccnnnntgtntgnannnnaacggcganatcancnantacgagtatgaaattgcggcagccgatcgnctctcggcaatcccccgtttgacggatgtcactcgctccacccgggtgcacctgactggcctgttgccggccacctcctacactgcccgagtgcgcgccttcaccgcccgtggtgccggaccatggtcgcccgaattgcgcttccaaacacgaccggctgcaatgcgagaccagccgcagnnnnnncctcgggtgtttgccactgggccaagggaagcccagctggtgtggcaaaccagccaaggccaggccaactactgggacaaattcgcttgccaatgggcacccgtgggaacaccgcaatatcaggcattgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcttctgcgctgtaccgccttcatcgtgagcgtaacaccacgggatgggcgcgagcctgcacgccaattccgggtggacggcagcaccagccagtacttggtggatgggcttcggcccggcaccgtgtacgctgtcagtgtgcaaccggtcgtcaatgaccggccctgtcccggcctcacagtcgacatgtcaaccgacccggagccaatcatccaattgcaannncggcctcgcattgttgaggagagggccacttccatcaccattgcctgggatgtgcccccggcacaatgctcgtccttccttgtcgagtaccgtgtcgagtccggcccctggcagnaantnncccaacnggtgccctatgagcccggtcgcgncaantacagcncnncgntggacggnctgncnccggacantgcctacgacntgcgnatccangtggtggaccnccannaccaagtcagcganncatctcccgaagtgcgcgcccncaccnaatgttcgccgccaanccanccgccgnccggactnncgntggattcnccngaccngcgncaagtgcgtgtcanttgggnaccgctggccaaaagnagntggcnttgtgccnanntnaacattganntggnntacngnannggnnnncanccngnnngnnnnntgnnngtgccnggcgacaaggtggagcatgtgttcgcgtcggagccaaacactcgctggactgtccgcctccgggcaaccaaccaggccggcagcagcccgtggggacccgagcaaacgctgacaacgcgccaaggagcgcccggacatgtgctgaacctgcagttgacaccgctgtcgccaaacgagatccgggtgcgctggtcgccgccagccgtacaacgcggcaccattgttggctacgacatctcgtatcgactgaagcacaggctggcctgtcccgaggaggagcccagagacgtgagccgtgactttgttaccatctacaactacaaggacacggaatacacgctgaccgggctgttgccaaattctttgtacgaagtgaaggtgcgcgcccgcacaacagaactgggcccggaggagactcgtgagggtgccaccctgcaacaaccgccnanngnncnnccnnnnaanntncnnntnncctnngnnnnnnnnnnnnnnnnnnnnttncnntggnannnnntngantgcnngcnncgncanggccnnatccttgnctatgantacganntngtgggcnangannncngngnnnagnnnnnnanncnnannnnananncnnccnnncanngnntnncantngangnnctgacnccntacacnnantacnnnnnccgngtnngngnnnnnaacngnnnnggcgnnggnccanncncngagnanntnnnnntnnnnacnnngnnngcnaatgcgcctttgccgccccaggatttggtggtcacccaggagggcatcaattgnttcaccgtctcttggctgcccccttatccgccctatgggccccatgaccgctacaaactgcagtaccaaagtgccgccgcaaatgattggcgcacaattgaagtggacgctcgcagccgtgagttggaatgcccggtgcccggaccgcgactctgctacaacatcactggactggaccaaggtcaacagtatcgggtgaaagtggccgcacacattgagggcggcacttacgggcctttctcacagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaacaccacgggatgggcgcgagcctgcacnnnnnnnncnggtggannncnncannnnnnantacntgntngatgggctnnnnccngnnacnntgtacnnnntcnnnntgnnnncngncnnnnnnnanngnnnnngncccgnnntnnnngncnanntnnnnacnganccnnnnnnantncccnnnnnnntncannngccnnnnntnnnnnnnganngggcnnnnncnntnnncntngnntggnntggcgttgtgnncncnnnnnnnnnnnnnncnnnctncnttgtngagnncngnnncnnnnnngnnccncagtggnngnaanngnccnnnnngntncnnnnnnagccnggncgnnncanntacnnnncnnnnntgnncggnctgnnnncnnacannnncnnnnnnntncgnntcnnngtggtgnncnnncnnnancnanncagngnnncnnnncccgaagngcnngnccnnaccnnatgnncgccnccnnnnnnnccnccgnnnggnctnnnnntgnantcnncnnnnnngcnnnaagtgcgnntcanttggnnacngcnngncaannnnagntggnnntgtnnnnnnntnancnnnganntngnntacngnannggnnnncanccngnnngnnnnntgnnngtgccnngcgnnnngnnngancatnnnttcnngtcngngccnancacnnnntggnntgtccgcntncggncnannaaccnngcnggcnnnnnnccntggnnacccnagnnnncnctnanaacnnnnnnnggnncnccnggnnntgtnnnnnanntgcnnnnnnnaccnnnnnnnccnaacnnnntnnnggnnnnntggncgccnccngccgnnnnnnncgnnnnnatnnnnggctacnnnntnnngtannnnctnnnntccattggcgagtgcggccctgcttccgcaaagccaatcacaaaacacacccgcgagccgcaattggagttggacgggctggtgccggactcaacctacgacatttacgtgactgcccacaccacacaggaaggaccaaaatccaaagtggtcactgtgcgaacagaggagagcggnccaaccggccaacccaaaaatgtgcgcgtcgcctcagtaacatccaaccgggcggaattgctctggaacgaaattgagtgcgagcttcggcatggccgcatccttggctatgactacgaggtggatgatctcagcggggagggccgcaacctcagccaacagtcgaccggccatcgtgtttcattggacgacctgaccccgtacacggagtaccgggcccgcgtcagggggcgaaacagcaaaggcgagggcccattctcggagtatgtcacgttccgcacattgccagccgcnccgccgccaccgactgatttgcgcgaggaagagcagttggaccatgcgctggaaatctcgttcctgcccccgcatccccccaatggcatccttgaccagtaccgaatccggtggactttgcacggcaaattcaactaccgtgagcagcgagtgcctgccttccaattggaatgctccagcccacgcctcagaggccgcctttgctatcgggtcaccgggctggagccagagcaggaatacgaaattcaggccgctgcccacacagagcacggggattggagtgagtggagcgaaccgctggtgaccagcacaatcccccaggcnattcccgtgctggagaccccactggagctggactttgtcaagtccaccagcattggagtgcgttggcgcggcttggaggaacgcctggccgagaacattgttggctatgtgctggagtacaagtccgagaatgacnnngcggactggaccgagtggaatggagtggtgcgccatcggccaagacaacccgactatcgggcggctgtgaagggattgacagaatcaaccgaatacttcttcaggctcagagtggttggcaagaacgacaagcgtggcggtcctgggcccgaactgaaggccatcaccaaatgtggaagncctgaaaagccgcccggcaatgtacgactggaggccgttgacttccagcaagtgcgcgtcctttgggaaccgccagaggaggaaagctggaaatgcgaccaagtggagtttgtgctgcactattccaattcgagtggccaacaaaaactcacatttgcacccgatggtccgcgcgaagttgttttcgactcggtgccgggcagccgatgggaggcaaaaatgcgcacccagacggtggaacctggcgaggagcccaaccattcggcatggagtccacgcgctgtgctggtcacaaaatcgttgcccgaccaaatcttcctgaaagtgacgcccaaagggccaacccaaggtgaagccatttgggaccttccggcggactaccaggactggccatggggcgttgacctgcagtacaggctgacacggctgggcggctgcaagaagttcgacaaggcgttagcagagccggttgtgatggagaatgtgcaggacaagcaagtgctgctggacaacctctacccgggcagtgagtacgaagtggtggtcaccctccgccaaccgcctggctttgaccgtcgagtgccgcccnngnaggngnnncnnnnnnnnnnnaccnngnancaacngccnanngnancgccncnnnanntncngntgnnnnnnnncnnngannnnnnncttnccttnnnntgggaaccnnnngantgntngnagcnnnacggcnanatcnnnnnntangantacganctnnnnggcnnggangantggnnnnagnnnnnnngnnaagnnnncantncncnnnnnaggnnnnnnatngnngngntgnngccnggctcgctctaccgtttccgggtgcgcgctttcacttccgccgggccaggcccatggtctgagccaattgatgcgcgaaccactgcntctgaaattggaccgccccgggagttgacggcagtgaagacggcggacacattcatccagctggcttggctgccgccccacccagaaacatcgccaattgttgcctaccgactcaagtacgggccttcgtcggacaagtcacggtcgcaagagatggttttgcaaggtgatgaattgagctgttcgggctacgagagtgccctgttgacggccgaccatttgtgcaccaccgtgagtggcctgaagccggcaagcacctaccgtttcgcggtccaagcccaagcagtcagcggcaactggggcccattcacttccgactattacgcgaccaccagccccgaagtgcacgagcttggcggcggctccctcaagatgctctcccacggccatgacaacatccgcgtcaaatggacgcccccgggagttgttggcgacaacattgaccagtacgaggtgttcatctcggtggcgaccagcctggaccagcagccgcgccgtttcgagacgcccggcagtcagacggaataccatttcaagggattggagccagtcacgctgtacaatgtgtcggtgcggggacttcagaccggcaaatcgttgtgggcaatctccggcaacttcccaacaactgacatgaangaaaccatgctggactggctttccggctgcactgaaatgcgtcttattgagaaggcggattcaatgctgcacgtcacctggactccgcccgacattttcgagccagaatatcggcatttgcacacccactatcgagtgacaattgagccagtcgatggctattcaatgcgccccggggcacgcaaaaactacacagtcatgggncccggcaattccatcaaattcacgganttncaacccgagacttcctacaacatcacngtgcagggaggcaccgacnttggctatggccagccagtttggggcntttggcaaacattnccaatgggcaagacctggattctncggctgaaggacaagtcnccgacaacactcacactggagtgggacccagtttggggctttgcgcacagcggatacattntganngcnaaagcgttgtactcggcaggctctcacattcgtcacggttccatccaaagctttgatgttagcccgcaggcaacggaattcacgttgaggggactggatccgaccagcacctacaatgtgacgctgtcactgaaggaccaaatggatggcgcttggggagtctactcgacaatgctgccgggctgtcatttgccaggcaatgtgaagcactgcgaccaaaccaatcacgccacttccatgagctgggaaccggtggagctgaacgcagccacccactaccaagtgcgctacatccatctgcattccagtcgcactctttgggtggaagagcccgagaagcaccggaaatacttgctttgtcccaaggacccgtgcaatcggctctgctacttggtgttcaatctgccgcaccatccggaggagtacgccttcatggtccgtgcccgggtggatggtgtttggaacaactggaaactggctggccgtcccnnnaccattgcggatccgccggaagtgaaggagaattgctgcattgtgccgcccccctaccatgtggaccacattgggtcgcccggcaccacctgggatgttccggtggcgccatcgccaaccgagaagaacatcacccgctactatgtggtggtcgatgaacgcgacccaccgggcgacacaaactggacactgttgacggacaaagtgacggcgcatcggctgaagattccctactatgtgaccggctcgttcagcaccgaaacgctggatgtgcccacaacagtgcggattggggatggccaagtgattgggggctacttgaattacccgctgcaaaaaggcaaaacgtacaactatgaggtgaacaagggagggagtgttgaccttgccatgccattnccctaaattccagcaacgcctttcctttccgccggatggccctggtggtggctgctgttgctgttgctgctgctactgctgtgcattctgttgacctgtttgctcctttggctgctaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggagggctatgccaagggattgcgcgattctggcgaccgtggcatgagcacctccatgtccaacttggcccagcggcccacccaaggctactcctccggctacatgcaaggcttccgcgacggcaattccggcgtattcggggatcggatcagtgaaagtctgttgaagcgattggaggagcaataccctgacaacgaggagttccgtgccggctacattgatgggttcaaggacggcgtcaacgggggaagagtaggcggattgagtttcgaagattcgcgccgcattcagcaaagtttgacggaattgaccgaaaggctgaccactattgaaaagaccaagggcgacgaaatccactccaccaagatctaccatgtctacaaccaatcgcccgaannnnnnnnnatgctggctcaaggacaacaattggtcagcgaactggaggagttggcttctggctcgcgacgaagcacactgcgacggcactacacaccgggcgattacctgcgggaggaaggccaacaggcaggaggcgcacttgccgagtacaacagnacagaaagttccgctgttgcggcatcatcaacggccgcaggcttcgcagaacggcaacgccatcattcgggcgcctcattggaaggccgtcaagggatgatggcccagcagcagcaggagggatattcacgcagtgtgcgccaacaacaaagtagcggcggctttgcccagggccagnnnnnnnnntacagaagccgctccgagttgggcagtccgcgacggtacgcatcccaaacgctgttggatggggccaggccgggcccaacaacgccgcattcacgtcgggatgctctacaggagttgcaaagggagttggactcgctggcaagtcggtcacccgcgggtggcaccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 377 - DNA, 1098 bp, Artificial Sequence
  Description of Artificial Sequence: Synthetic polynucleotide
  modified_base (1)..(300): a, c, t, g, unknown or other
  modified_base (418)..(421): a, c, t, g, unknown or other
  modified_base (423)..(427): a, c, t, g, unknown or other
  modified_base (430)..(430): a, c, t, g, unknown or other
  modified_base (432)..(432): a, c, t, g, unknown or other
  modified_base (434)..(435): a, c, t, g, unknown or other
  modified_base (541)..(1098): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattgatgaacatcgactacgaactcgtgggcttctaccaagcccatccattcggcgcctgcttcagccacgacatgctcgactcactggccgagtaccaaagtcagcagcccaacnnnntnnnnnttntntnngacccaatcaaaacacgtcaaggcacgctgaccctgcacgcctatcgtttgactcgcaaagcactggagctgactgtcaacggggagtggacgccggaaatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 378 - DNA, 399 bp, Artificial Sequence
  Description of Artificial Sequence: Synthetic polynucleotide
  modified_base (1)..(90): a, c, t, g, unknown or other
  modified_base (267)..(267): a, c, t, g, unknown or other
  modified_base (287)..(287): a, c, t, g, unknown or other
  modified_base (289)..(289): a, c, t, g, unknown or other
  modified_base (293)..(295): a, c, t, g, unknown or other
  modified_base (297)..(297): a, c, t, g, unknown or other
  modified_base (299)..(303): a, c, t, g, unknown or other
  modified_base (305)..(307): a, c, t, g, unknown or other
  modified_base (309)..(312): a, c, t, g, unknown or other
  modified_base (314)..(317): a, c, t, g, unknown or other
  modified_base (319)..(328): a, c, t, g, unknown or other
  modified_base (330)..(330): a, c, t, g, unknown or other
  modified_base (385)..(399): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgatcccgacgaatatggtcattatccggacccgattgaacacaactacggtctcgagaagaaaatgcttatgggccgtctgattggcgacgatcgatacgagccaaaaatcttcttccgcaatgaggagtccacgtacgactatccaaatttggtgccaactctgagaaatgangcacaagttgcctgctattntnaacnnnanannnnntnnntnnnnannnngnnnnnnnnnnangggctccccaagcgatgcgagtgcggacattggtatttccatattgaagttgagnnnnnnnnnnnnnnn

SEQ ID NO: 379 - DNA, 2397 bp, Artificial Sequence
  Description of Artificial Sequence: Synthetic polynucleotide
  modified_base (1)..(225): a, c, t, g, unknown or other
  modified_base (484)..(636): a, c, t, g, unknown or other
  modified_base (667)..(672): a, c, t, g, unknown or other
  modified_base (813)..(813): a, c, t, g, unknown or other
  modified_base (1039)..(1041): a, c, t, g, unknown or other
  modified_base (1480)..(2397): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcttatcttccggagaagatcacaatattctcgacattggttggtgtcctcaattcgcgatcgcaggaattcggagagcggttgattgcaaagttcatggacgagttgcacaacacctttgtcactcaggaatatgacatcgccatccgcattgtgactttcttgtgtgatcttggcaattcccgtgtggtcacattgaattcaattcttgattttctcgaggaccttgttgagatggctgacgtggagaatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctccaagtctggtccgacccatcatttnnnnnnccacagggcgactatttggacagtctttgggcgcaattgcaaaagctgaaagaggccaactgggtggagaagcacattttacgaacctacgcgcacttcacttcgatcctgaacgagtcggtacaacacgaattgccaagnctaaatcgcggagttctgcaggaaagcagcaattacccacttccccgggttgtttttcgtctcttccaaccaaccgattgcacggggtttgttgaataaaaattgccagcagacgatgcaattgaacgctttctggttgaggaggacctgaactggatcatcgacaacaactacaccgattggaagctttgtgcccgtgcactgctcaactactaccggaaagagnnnaatgttccgctgaactacgtgatcatcgagacgattttcggccaacttttccgacttccaaatgcggcacatttggaaattttctacggtgcgcttctcattgaactctgtcgcacccaggcaagctctcttccacaagtgttggcgctggctgcggaaatgctcttccaacgggccgacaccatgcagccaatctgtcttgaccgattcgtcgactggttcagctaccatctttccaacttcgagtatcgctggtcgtggcgcgattgggcggattgtgttgagttggattccctccatccaaagcgcatttttgtgcgcgaagtcatcgacaagtgcatgcgcctttcctatcacaagaagctgaaggaatttttgcccgaagaatttgctccgatcatcccagacgaaccacaaatcaactatgttctggacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 380 - DNA, 3381 bp, Artificial Sequence
  Description of Artificial Sequence: Synthetic polynucleotide
  modified_base (1)..(1083): a, c, t, g, unknown or other
  modified_base (1138)..(1140): a, c, t, g, unknown or other
  modified_base (1197)..(1197): a, c, t, g, unknown or other
  modified_base (1464)..(1464): a, c, t, g, unknown or other
  modified_base (1704)..(1704): a, c, t, g, unknown or other
  modified_base (1873)..(1887): a, c, t, g, unknown or other
  modified_base (2101)..(2247): a, c, t, g, unknown or other
  modified_base (2373)..(2373): a, c, t, g, unknown or other
  modified_base (2569)..(2571): a, c, t, g, unknown or other
  modified_base (2652)..(2652): a, c, t, g, unknown or other
  modified_base (2847)..(2847): a, c, t, g, unknown or other
  modified_base (2959)..(3159): a, c, t, g, unknown or other
  modified_base (3322)..(3324): a, c, t, g, unknown or other
  modified_base (3379)..(3381): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccaagtgattgaggatgatcgcagctcacggtcgggccttttccccaccggtnnnccacaagccgagttgcctccgctgatcaccaccgagttcattgcacaggatcaagcnaattcaaatccaaagttcatgcgttccaccatctatgcggtgccctcgaacagtgacatgatcaaggcgacccatttgccgctgtcgttggccatcacgccgttcgctaaattgcataattctgagtatccgcccccaaccattgatcttggcgacattggaccggtccgttgtttgcgctgcaaagcctacatgtgcccattcatggagttcatcgacgggggacgcaaattccgttgtcccttctgcaaggcgagcacagcaatngcggacggctatttcgcccatttggaccacactgggcgacggacggacatccagcaccgaccggaactttaccttggctcctacgagtttgtggccaccaaagaatattgcaagaatggcattccaccaaagcagcccgccttcattttcatgctggacgtgtcctacaatgctgtccggaccgggttggtcgagttgttctgccgaaacattggcgaactgctgcgggatttgccacgngagaatttccacgagaagtcgagcatgcgaattgggctggccacctacgaccagtcggtgcacttctacaacctgagccagccggaagcggaaatgctggtggtcaacgacattgccgacatttttgtgccttttgtggacgggttcctggtggagtttgagcaggcgnnnnnnnnnnnnnnnagttgtcttcgcgagattgtcaacaacttttccaacactcgcatcacggaaaccgccctgggcccagtgatccaagcgggattggacgcgttgcggagtgcggaccgggccggaaagctgttcatctttcacacctccttgcccactctggaggcaccgggccagttgaaaaacagggaagagcggaagctgttgggcaccgacaaggaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttttaatattttttttgcaggccgaacgtgacggcgcccgtttcctggccgatctgcgccatgacatcagccgagaggtggtcttcgatgtgatgcttcggctgcgcacatcaaccggtttnaattcggccaccttctttggcaatttcttcatgcaaaacacgacggacattgagatgagcgcgctggactgcgacaagtcggtgcaaatcgagatcaaatacgatgacaagctggacgaggagcccgcctacttccagatggccgtgctgttcaccagttgcgggggccagcgccggcttcgcatccataatgttnnnttgccggtcaccgccgactatgcccagctgtatcggctaattgacgaggattgtttggtcacgcatttgtttaaacaagcngagcaactggtccgcgagaaagcgcccaaggagatgaaggacgagctgaccgtgcgctgtgcccaaattttggccgcctaccgcgagaagtgcagcgagtcggccccaatgggacagttgattttgccggagctggccaagctgcttccgcttcatgtgaactgcattctgcgacatgacgcactcactggagcngccgagctgaccgtcgacgaccgtgcctggatgatgagtttggtgccgtcgatgagcccactggcggtcagccagttcctgtacccgcgcatctaccccctgaccggacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcccgagcgcgacaacccccattcccgtgccctgcgccgcctcgcccacgtgaacgccgaccgggagcgccacctgaagctgttcattgtgaaggagcaggacgcgctggagtcgtggatgaagaagttctggccgaggaccggtacgaacaacgcgcacnnntcctacgtggacttcctgtgccaaattcaccgagagatccgaggcattttgactnnn

SEQ ID NO: 381 - DNA, 543 bp, Artificial Sequence
  Description of Artificial Sequence: Synthetic polynucleotide
  modified_base (10)..(10): a, c, t, g, unknown or other
  modified_base (12)..(12): a, c, t, g, unknown or other
  modified_base (60)..(60): a, c, t, g, unknown or other
  modified_base (66)..(66): a, c, t, g, unknown or other
  modified_base (72)..(72): a, c, t, g, unknown or other
  modified_base (94)..(94): a, c, t, g, unknown or other
  modified_base (96)..(96): a, c, t, g, unknown or other
  modified_base (118)..(118): a, c, t, g, unknown or other
  modified_base (151)..(151): a, c, t, g, unknown or other
  modified_base (155)..(155): a, c, t, g, unknown or other
  modified_base (158)..(158): a, c, t, g, unknown or other
  modified_base (166)..(166): a, c, t, g, unknown or other
  modified_base (168)..(168): a, c, t, g, unknown or other
  modified_base (196)..(197): a, c, t, g, unknown or other
  modified_base (204)..(204): a, c, t, g, unknown or other
  modified_base (226)..(226): a, c, t, g, unknown or other
  modified_base (228)..(228): a, c, t, g, unknown or other
  modified_base (496)..(543): a, c, t, g, unknown or other
atgttcaatntncaagaccgaatcaaaggaatcgacaaggaccgcgaatatcacgcaacncgcatntccatncgtgataaacttctctcacaangngcaaagcaacttgagcaaaatntgcgcgataacctgcaagttgaccttcccctcnacanccnagaacggnantgtttgcacgagatggagctgacggtcnngccgaanaccggattatacaaaggcggcntnttcaagttcaaaataacggtgcccccggaatacaacaacgtgccgcccgttgtgaaatgcctgaccagagtctggcacccaaacatcaacgaggacggtagcatttgcttgagcttgctacgtcaaaattcgctggatggctttggctggatgccgactcgtcgcattcatgacgtcattcttggtttggatcagctcttcaccgacctcatcgactttgacgacccgctcaacgctcaggcggcgcagcaatggcagggcaacaagnnnnnnnnnnnnnnnnnnnnnnnnnnnnnnnnnnnnnnnnnnnnnnnn

SEQ ID NO: 382 - DNA, 588 bp, Artificial Sequence
  Description of Artificial Sequence: Synthetic polynucleotide
  modified_base (1)..(150): a, c, t, g, unknown or other
  modified_base (210)..(210): a, c, t, g, unknown or other
  modified_base (394)..(444): a, c, t, g, unknown or other
  modified_base (525)..(525): a, c, t, g, unknown or other
  modified_base (574)..(588): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggcgccaagcagtcgcgctcggagaagaaggcacgcaagctgttcagcaaactcgtnctgaaacaagtccatggcgtctcgcgcgtgtgcatccgcaagtccaagaacatcctgttcgtcatcaacaagcccgacgtgtacaagaacccgggctccgatacctacattgtgttcggcgaggccaaaatcgaggacttggcgcagcatgcgcagatcaccgacgtggagaacctgaagccgnnnnnnnnnnnnnnnnnnnnnnnnnnnnnnnnnnnnnnnnnnnnnnnnnnnctccaggctgacgccaccggctgcgaggagaaggacatcgagctggtcatgtcccaggccaacgtgtcacgcaacaaagcnatcaaggcgctgaaggaggccaacaacgacctggtcaatgccatcatgnnnnnnnnnnnnnnn

SEQ ID NO: 383 - DNA, 1161 bp, Artificial Sequence
  Description of Artificial Sequence: Synthetic polynucleotide
  modified_base (1)..(27): a, c, t, g, unknown or other
  modified_base (226)..(228): a, c, t, g, unknown or other
  modified_base (520)..(594): a, c, t, g, unknown or other
  modified_base (817)..(819): a, c, t, g, unknown or other
  modified_base (1069)..(1161): a, c, t, g, unknown or other
nnnnnnnnnnnnnnnnnnnnnnnnnnnatttaccttggattgtccgtcaaattgccgcccgaccaactcttcacgcttgagcgccatttcctcccacttggcaaaattggcggattcccggcatggctcaatccaatggctataccttcagcggatgaattggcttgttcgaattgtggaaccccaatggcctttttgctgcagatttattgcactcatccggccnnngatccgccccatgccttccatcgggtgctttacttgttcatttgccggcaaggaacatgctcaaagaccaatgacgcctcaaatttcgccgtcttccgctgccaattgcctcgccaaaatgctttctacagtgccacggaagccctgaaacctgcggtggttggtgaccagcccgacccattccatgccgaaacccatgcaaaattgtgcgctgtttgtggctgccgggcgggcaaacgttgtgcaaagtgtgcacgcaggcattactgttccagggagcatcaaatcattnnnnnnnnnnnnnnnnnnnnnnnnnnnnnnnnnnnnnnnnnnnnnnnnnnnnnnnnnnnnnnnnnnnnnnnnnnnaagcatggcttcacattccccgaatacgggattcgaatggacgaggaagcaagtgatggcagtgattcggaggaagacagcgatgaagatggagacgaagagatggaggtggacaatgacgaggaggcgatgaagaaaatcaagcagttcgaggttttgttttattctaaaatttacaagaaatccagggccaaagccaatggcgtcacggccaaagattgtnnngaaggccttgaggagagcaagcaggacatggcattccgtcggtttagccaagcacttgatgatgaacccgaacaagtgttgcgctatcagcgcggaggaaagcccctgctggcaaccgactactcgccagcacccaatcaaattcccgaatgcccactctgccatcagcccaggcagttcgagttccagttgatgccgcacttgctgaccctcatcgatgtggattccattgggcagagcttggattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 384 - DNA, 2835 bp, Artificial Sequence
  Description of Artificial Sequence: Synthetic polynucleotide
  modified_base (1)..(672): a, c, t, g, unknown or other
  modified_base (687)..(687): a, c, t, g, unknown or other
  modified_base (761)..(761): a, c, t, g, unknown or other
  modified_base (784)..(789): a, c, t, g, unknown or other
  modified_base (822)..(822): a, c, t, g, unknown or other
  modified_base (840)..(840): a, c, t, g, unknown or other
  modified_base (880)..(2835): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcagttccaaggnactcgttcaattactcagcttcgtcaaaaatggtgcaatgaactcagtcctgtttacaaccaagaaccatggantgttgaggaggatgaaagattgnnnnnnttggatattgccagggacgttcacaactggganactattgcgcaaatgttngggaccaatcgaacatcattccactgcttcgagcgacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 385 - DNA, 2757 bp, Artificial Sequence
  Description of Artificial Sequence: Synthetic polynucleotide
  modified_base (1)..(1104): a, c, t, g, unknown or other
  modified_base (1248)..(1248): a, c, t, g, unknown or other
  modified_base (1369)..(1371): a, c, t, g, unknown or other
  modified_base (1464)..(1464): a, c, t, g, unknown or other
  modified_base (1468)..(1470): a, c, t, g, unknown or other
  modified_base (1648)..(1707): a, c, t, g, unknown or other
  modified_base (1846)..(2757): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctccatttagatccacccacaatcagaggaaatttcgtggactttctaaaattcaaagaaccttggtgtttgagcaggcaacttttatggggccataaaattcccgcgtattttgtggaggatacaaaaaggttttcatangaagcacgccagaaacttacagagaatgagttggattccccaataatccaggatccggatgtgcttgatacatggttcagctcctcactcattcccattgttgttgctggttggcccgatnnnaaagaagttggggaagatgtattggatctgatggagactggtcatgacattattggcttttgggtggcaaaaatgctgatggtttgccaaagnttannnacaggacattatccattttcaaatgttctcgttcatggattgattcaagacagtcagaataggaaaatgagcaaatcgctgggcaatgtgattgatccgatggatgtcatcaatggcatcagtttggagcagatgttggaacgattgcgcacttcaaatgttccaacagaagaaattnnnnnnnnnnnnnnnnnnnnnnnnnnnnnnnnnnnnnnnnnnnnnnnnnnnnnnnnnnnnaattgctttagattcgctcttttccgtcacgatttaactgattttcaaatcaagatggacattcctaagtttgctgaagagggcttacgcttttgtaacaaagtttggaatttatgcaaatacgtggagaaagtttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 386 - DNA, 966 bp, Artificial Sequence
  Description of Artificial Sequence: Synthetic polynucleotide
  modified_base (1)..(48): a, c, t, g, unknown or other
  modified_base (78)..(81): a, c, t, g, unknown or other
  modified_base (84)..(84): a, c, t, g, unknown or other
  modified_base (88)..(90): a, c, t, g, unknown or other
  modified_base (96)..(96): a, c, t, g, unknown or other
  modified_base (99)..(103): a, c, t, g, unknown or other
  modified_base (105)..(107): a, c, t, g, unknown or other
  modified_base (117)..(117): a, c, t, g, unknown or other
  modified_base (119)..(123): a, c, t, g, unknown or other
  modified_base (126)..(127): a, c, t, g, unknown or other
  modified_base (133)..(135): a, c, t, g, unknown or other
  modified_base (138)..(138): a, c, t, g, unknown or other
  modified_base (144)..(145): a, c, t, g, unknown or other
  modified_base (147)..(147): a, c, t, g, unknown or other
  modified_base (151)..(151): a, c, t, g, unknown or other
  modified_base (154)..(154): a, c, t, g, unknown or other
  modified_base (156)..(158): a, c, t, g, unknown or other
  modified_base (161)..(162): a, c, t, g, unknown or other
  modified_base (165)..(165): a, c, t, g, unknown or other
  modified_base (205)..(489): a, c, t, g, unknown or other
  modified_base (503)..(503): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (534)..(534): a, c, t, g, unknown or other
  modified_base (543)..(543): a, c, t, g, unknown or other
  modified_base (703)..(705): a, c, t, g, unknown or other
  modified_base (931)..(966): a, c, t, g, unknown or other
nnnnnnnnnnnnnnnnnnnnnnnnnnnnnnnnnnnnnnnnnnnnnnnnatctacactggcccggagatggatggggannnntgngttnnncacccnggnnnnncnnntttccatgangnnnnnaanntttggnnntgntgtganngnaaancancnnnttnnggngcatttttggaccaagccggatgcagtcgggggaagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaaggaagagnagaatgtgttcatcanccnggngttgctgtnttccatgangggatgaagttttggtcttgctgtgagcgcaaaacaaccgattttggggcatttttggaccaagccggatgcagtcgggggaagcattgttgggtcaagaatgaacgcattgacaatgtccgcgaggactggttccaacgcagtggccaagtgcacattnnnatctattgcaaaggcgcatcctggaaggggaccctggtcgagacggacgggatcaacctcaaagcgacgataaagcatggattcggcagcaaggagactgttcgggaatacgacctttttggtgaaattctgcccgtggaaagcgaggtcctgataagcgagcgcaaagtggaattgctgctgaagcaggcaacccgggaagcatggccgcgattgtgctacgaannnnnnnnnnnnnnnnnnnnnnnnnnnnnnnnnnnn

SEQ ID NO: 387 - DNA, 1701 bp, Artificial Sequence
  Description of Artificial Sequence: Synthetic polynucleotide
  modified_base (1)..(1029): a, c, t, g, unknown or other
  modified_base (1245)..(1245): a, c, t, g, unknown or other
  modified_base (1357)..(1701): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatccgaaagtactggaaccaacgcatgcgcttcttcacccgtctgaacaagggcattctgctggaccgcgagggctggttctcggtcacgcccgaactgatggcccgccatgtggcggaccgactggttcgcatccaggactgcaccattttggacgcgttcactgggcccggcgggaatgccatccagtttgcgttgcgcggggcattcgtntttgccattgacattgacccggtcaaaatccgctgtgctgcccagaatgcgcgggtctatggcgtctcgcacaggatcaacttcatttgtggcgacttcttccagattgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 388 - DNA, 618 bp, Artificial Sequence
  Description of Artificial Sequence: Synthetic polynucleotide
  modified_base (1)..(66): a, c, t, g, unknown or other
  modified_base (358)..(358): a, c, t, g, unknown or other
  modified_base (360)..(360): a, c, t, g, unknown or other
  modified_base (363)..(364): a, c, t, g, unknown or other
  modified_base (370)..(373): a, c, t, g, unknown or other
  modified_base (375)..(375): a, c, t, g, unknown or other
  modified_base (382)..(387): a, c, t, g, unknown or other
  modified_base (428)..(428): a, c, t, g, unknown or other
  modified_base (430)..(430): a, c, t, g, unknown or other
  modified_base (502)..(504): a, c, t, g, unknown or other
  modified_base (559)..(561): a, c, t, g, unknown or other
  modified_base (592)..(618): a, c, t, g, unknown or other
nnnnnnnnnnnnnnnnnnnnnnnnnnnnnnnnnnnnnnnnnnnnnnnnnnnnnnnnnnnnnnnnnngacatagacgacatcgaagagaagatacgccaaattgagcaagaagctgagaaaatccgtgcaatgcaaaatgattccgaaatgtttcaaggctccgcatcagcaacaggaagtcccggcgtcaaccaaaatctttctgttgaggagaaaatgctgatcgacagtcgatccatctacgtgggcaatgtggactatagcgcaacacctgaccaattggaagaacactttcgcggctgcggctccatcgaacgtgtcacaattttgaccgacaaattcacaggccatccgaaangnttnncctacnnnnanttcgctnnnnnngaaggcatgcaaaattcgctgtctctcggcgactcgctttncnttggccgtcaaatcaaggttgtgccaaaacgcaccaatcgtcccggaatcagcacaaccaatcgaccgccgnnncgcggcgcaggaggtcgtggacgggctcgagtcgttatcaagtacatctatccgnnnggcatgcgcggtcgcggacgcccaccgaggnnnnnnnnnnnnnnnnnnnnnnnnnnn

SEQ ID NO: 389 - DNA, 1002 bp, Artificial Sequence
  Description of Artificial Sequence: Synthetic polynucleotide
  modified_base (1)..(3): a, c, t, g, unknown or other
  modified_base (190)..(237): a, c, t, g, unknown or other
  modified_base (421)..(1002): a, c, t, g, unknown or other
nnngcaaaaatgtccaccgaagtgcaaaagctgatggaaccctacattgacttgggcaatttgctgctaattgaccgcgatcccatcgagagccaggctgccgaccaattgaatgagttgacccgcgacaatgtgcaatgcctgttcaacaaaatttggacgcttccgcgcaaaatcgtggagaacgcgnnnnnnnnnnnnnnnnnnnnnnnnnnnnnnnnnnnnnnnnnnnnnnnncagattccaaagcccaagcagccaaccaaatgggagcagttcgccaaagccaagggcattgtgaagaccaagaagagcaagaaggtttgggacgagacggaacaggattggaagccccgctatggctaccggcgtgcaaatgatgacaagaaggattggctcattgagattcccgatcaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 390 - DNA, 2049 bp, Artificial Sequence
  Description of Artificial Sequence: Synthetic polynucleotide
  modified_base (1)..(126): a, c, t, g, unknown or other
  modified_base (232)..(240): a, c, t, g, unknown or other
  modified_base (343)..(345): a, c, t, g, unknown or other
  modified_base (382)..(2049): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttctgcacgtttctcaccatcgccaggccaggaacacatattggctcttggctccgaggatggcgtgatcgatatatgcgacatcaaaaaacttgaaaagaaannnnnnnnntacagtttcaaatccttcaatctctctccggcaaattccaatgctgtttacgacttgtgcttcattccaagcgattcgaacaagctgatctccctttctggcnnnaacacagcattcttatgggaccttgaacagaaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 391 - DNA, 1464 bp, Artificial Sequence
  Description of Artificial Sequence: Synthetic polynucleotide
  modified_base (100)..(102): a, c, t, g, unknown or other
  modified_base (120)..(120): a, c, t, g, unknown or other
  modified_base (292)..(384): a, c, t, g, unknown or other
  modified_base (551)..(552): a, c, t, g, unknown or other
  modified_base (556)..(556): a, c, t, g, unknown or other
  modified_base (558)..(563): a, c, t, g, unknown or other
  modified_base (565)..(565): a, c, t, g, unknown or other
  modified_base (652)..(714): a, c, t, g, unknown or other
  modified_base (768)..(768): a, c, t, g, unknown or other
  modified_base (770)..(770): a, c, t, g, unknown or other
  modified_base (780)..(780): a, c, t, g, unknown or other
  modified_base (832)..(832): a, c, t, g, unknown or other
  modified_base (834)..(834): a, c, t, g, unknown or other
  modified_base (864)..(864): a, c, t, g, unknown or other
  modified_base (868)..(868): a, c, t, g, unknown or other
  modified_base (873)..(873): a, c, t, g, unknown or other
  modified_base (888)..(888): a, c, t, g, unknown or other
  modified_base (912)..(912): a, c, t, g, unknown or other
  modified_base (955)..(955): a, c, t, g, unknown or other
  modified_base (958)..(958): a, c, t, g, unknown or other
  modified_base (960)..(960): a, c, t, g, unknown or other
  modified_base (993)..(993): a, c, t, g, unknown or other
  modified_base (1002)..(1002): a, c, t, g, unknown or other
  modified_base (1008)..(1008): a, c, t, g, unknown or other
  modified_base (1023)..(1023): a, c, t, g, unknown or other
  modified_base (1034)..(1034): a, c, t, g, unknown or other
  modified_base (1053)..(1053): a, c, t, g, unknown or other
  modified_base (1059)..(1059): a, c, t, g, unknown or other
  modified_base (1068)..(1068): a, c, t, g, unknown or other
  modified_base (1107)..(1107): a, c, t, g, unknown or other
  modified_base (1147)..(1147): a, c, t, g, unknown or other
  modified_base (1149)..(1149): a, c, t, g, unknown or other
  modified_base (1152)..(1153): a, c, t, g, unknown or other
  modified_base (1155)..(1155): a, c, t, g, unknown or other
  modified_base (1161)..(1161): a, c, t, g, unknown or other
  modified_base (1173)..(1173): a, c, t, g, unknown or other
  modified_base (1179)..(1179): a, c, t, g, unknown or other
  modified_base (1290)..(1290): a, c, t, g, unknown or other
  modified_base (1293)..(1293): a, c, t, g, unknown or other
  modified_base (1306)..(1464): a, c, t, g, unknown or other
atgtggaccctaaaaaatttgggtgacacttggatggtcaaaagcattgggcgacggccaattgtgctcggttcctcacatcacacagttgcgcaccaannnatccaaggcaatttcagngtgatccacttccttggcgatggtcgccaatcgcacagcctcttttgcctcagcgaggacgagaagggcacaaagcagctgagccaggcccacatcgagaggattcacaaaggcaaacgggcggccaatgatctttgtgcgtggagtggccatttggcggagtgcgaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtttcccctggtggtttgtattgccccaatgtacacgtacaccgactggcagatcatgataatgggcattgagacttggctggcgcttggcgcccaaaaattggttttgccaatccaatcggcttcttccgacacggtcttcatcctgcgggagtatgaacggcnngcantnnnnnncnttaggaaatggccaaaatggccgcttctctcggatgtgaaccccaatggattggttctctcccgtggcatcgaagagtcgcacgtgnnnnnnnnnnnnnnnnnnnnnnnnnnnnnnnnnnnnnnnnnnnnnnnnnnnnnnnnnnnnnnnctgatgccgctggatccaatggaagtgaaaccgggcatcaacctggatatcctnangggtcttttncgggaacacccaaatgccggctcattcctgtttgagcatcgcgatgttcagntnttgccggaatcgccggccaccgggaacacnttgnccaanttcaactttgacttnttgggcgccaccaaatggaagacnaattgcaaagtttggcgcatgaaaacccgggtggtcgtgaacncantncgtgtcgacagtgtgaacatgcacgagacgggnattctccgnctcggntttgcccaagtccgngtgccctgtcngcaagcccatttctaccanttgcgncattcctanaaggacatggccaacgaatggccaatccaaatggacaanttgcagctgcttttgaacgaacaatggaagcgcagaatgncngtnnantttggngcgcgccagaanttgctnacgccttcctcggtggaaagttttgctgactttgaccgttgcatgatggccatcaacgaggagcactggtcaatgcgggtgtcacgctgcttgaccccgcatgtttgctantcncggctggcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 392 - DNA, 4953 bp, Artificial Sequence
  Description of Artificial Sequence: Synthetic polynucleotide
  modified_base (1)..(141): a, c, t, g, unknown or other
  modified_base (193)..(195): a, c, t, g, unknown or other
  modified_base (466)..(4953): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtctcggcggattggccggcatgaaagcgttggacaacaattttgatttgnnntacgagcccgagctgttcgccaaggacaaactgaacatgaaccgggcaatgctgaccaaagaggaggccgaagcattgaatgagcaaattgaagcaatgattcttcgcctttgtccctattttcaccaccagtgttgccgacaagtcttggaatggctcatccacaagtaccaggtgcacacctacaatgcggagaacctgtttctggcgtttctgccctaccacgcccagaacacatttggccgacttctccagatcctccgcttcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 393 - DNA, 1233 bp, Artificial Sequence
  Description of Artificial Sequence: Synthetic polynucleotide
  modified_base (1)..(102): a, c, t, g, unknown or other
  modified_base (184)..(1233): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactcgaagaacgccgcaaatatggaatttactacaatgacgactatgattacctgaagcatttgaagcaagttggcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 394 - DNA, 834 bp, Artificial Sequence
  Description of Artificial Sequence: Synthetic polynucleotide
  modified_base (1)..(57): a, c, t, g, unknown or other
  modified_base (76)..(81): a, c, t, g, unknown or other
  modified_base (199)..(199): a, c, t, g, unknown or other
  modified_base (201)..(201): a, c, t, g, unknown or other
  modified_base (297)..(297): a, c, t, g, unknown or other
  modified_base (308)..(309): a, c, t, g, unknown or other
  modified_base (311)..(313): a, c, t, g, unknown or other
  modified_base (316)..(316): a, c, t, g, unknown or other
  modified_base (318)..(319): a, c, t, g, unknown or other
  modified_base (321)..(325): a, c, t, g, unknown or other
  modified_base (327)..(327): a, c, t, g, unknown or other
  modified_base (570)..(570): a, c, t, g, unknown or other
  modified_base (730)..(834): a, c, t, g, unknown or other
nnnnnnnnnnnnnnnnnnnnnnnnnnnnnnnnnnnnnnnnnnnnnnnnnnnnnnnnnccagtgaaaagctacacgnnnnnnaacaaccagtcggtcgaagaccaagcggccgacattgagcgcgaaattgagaagtgcatgcagcaatcgttggacagcacccaacgctcatgtcagcagctggactcctccgacaaantnaaaaccatcaaattcaaggagttactcgcccaacgtgagaagctggaacgtgccgaaaacaacttggacgaaattcacacgaccacccactacacncagcgcagttnnannngtntnnannnnntntttggtggcatgttcaagaacaagttttcgcgcttgcccaaggagaagtccaagaatggcacaatgaacaactccaagtcggccgaccaactcgctaaaattgtggaccgagtcaacaacggcggaagcagcggcaccggcggacagccacagcaacaacactcactgaacgcgtcatcgcgtgcccaaatccaaggcactcgctgggaagcaatggacaatcagattgaccagaatttgacncaaatgagttcccaactgtcccgtctgcgcacctggggcgtcgcaatcggcgacgaagtggacgaccaaaaccgcatgctgggacgcatccaaaccaagacggaacgcaatgacacggtggtgcgcagccaggacacccaaatgcgcaaactgctgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 395 - DNA, 369 bp, Artificial Sequence
  Description of Artificial Sequence: Synthetic polynucleotide
  modified_base (129)..(129): a, c, t, g, unknown or other
  modified_base (132)..(133): a, c, t, g, unknown or other
  modified_base (135)..(138): a, c, t, g, unknown or other
  modified_base (310)..(369): a, c, t, g, unknown or other
atgaatgccccggaacgtttcaaagctttcctgctggacgatgagaagaagatcgagatccaaaaggacatgaaggtcccaaacgccgcggttttcacgttcaacaaggaggaccacacgctgggcaanctnntnnnnagccaattgctgaaggacccgcacgtgctgttcgcgggctaccgaaatccgcacccgctggagcaccggatcctgctgcgtgtccagaccgactcgaacacaaccccggccgaggccctcgacagcgccatcaccgacctgatcgcggagctctcactgcttgaggagcgannnnnnnnnnnnnnnnnnnnnnnnnnnnnnnnnnnnnnnnnnnnnnnnnnnnnnnnnnnn

SEQ ID NO: 396 - DNA, 270 bp, Artificial Sequence
  Description of Artificial Sequence: Synthetic polynucleotide
  modified_base (1)..(15): a, c, t, g, unknown or other
  modified_base (34)..(36): a, c, t, g, unknown or other
  modified_base (40)..(40): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (55)..(57): a, c, t, g, unknown or other
  modified_base (60)..(60): a, c, t, g, unknown or other
  modified_base (64)..(64): a, c, t, g, unknown or other
  modified_base (66)..(66): a, c, t, g, unknown or other
  modified_base (68)..(69): a, c, t, g, unknown or other
  modified_base (72)..(72): a, c, t, g, unknown or other
  modified_base (75)..(75): a, c, t, g, unknown or other
  modified_base (77)..(77): a, c, t, g, unknown or other
  modified_base (79)..(80): a, c, t, g, unknown or other
  modified_base (84)..(85): a, c, t, g, unknown or other
  modified_base (87)..(89): a, c, t, g, unknown or other
  modified_base (145)..(145): a, c, t, g, unknown or other
  modified_base (150)..(152): a, c, t, g, unknown or other
  modified_base (158)..(158): a, c, t, g, unknown or other
  modified_base (169)..(169): a, c, t, g, unknown or other
  modified_base (180)..(180): a, c, t, g, unknown or other
  modified_base (186)..(186): a, c, t, g, unknown or other
  modified_base (264)..(264): a, c, t, g, unknown or other
  modified_base (268)..(270): a, c, t, g, unknown or other
nnnnnnnnnnnnnnnggtgttgtttgccacaccnnnatgncnganganatncaannngangccntngnntgngcnanannggcnntnnnaaagtacaacatcgagaaggacattgcggcctacatcaagaaggagttcgacaagnagttnnncccaanctggcactgcnttgttggccgnaacttnggctcctacgtggcccacgagacgaagcacttcatctacttctatctgggccaagttgccatcctgttgttcaagagnggtnnn

SEQ ID NO: 397 - DNA, 1869 bp, Artificial Sequence
  Description of Artificial Sequence: Synthetic polynucleotide
  modified_base (1)..(33): a, c, t, g, unknown or other
  modified_base (87)..(87): a, c, t, g, unknown or other
  modified_base (117)..(117): a, c, t, g, unknown or other
  modified_base (132)..(132): a, c, t, g, unknown or other
  modified_base (153)..(153): a, c, t, g, unknown or other
  modified_base (157)..(157): a, c, t, g, unknown or other
  modified_base (168)..(168): a, c, t, g, unknown or other
  modified_base (192)..(192): a, c, t, g, unknown or other
  modified_base (223)..(223): a, c, t, g, unknown or other
  modified_base (264)..(264): a, c, t, g, unknown or other
  modified_base (294)..(294): a, c, t, g, unknown or other
  modified_base (325)..(325): a, c, t, g, unknown or other
  modified_base (339)..(339): a, c, t, g, unknown or other
  modified_base (346)..(348): a, c, t, g, unknown or other
  modified_base (398)..(398): a, c, t, g, unknown or other
  modified_base (407)..(408): a, c, t, g, unknown or other
  modified_base (417)..(417): a, c, t, g, unknown or other
  modified_base (439)..(1869): a, c, t, g, unknown or other
nnnnnnnnnnnnnnnnnnnnnnnnnnnnnnnnngagccaaaaccgaaattgagtccgctccgaatcctggaattggtcaaaagtgcncagcaacagcatggacttcggcagcagaantacttgagatacagnggatattgcggtcgaagagtngagngaatccgaaantcgctgaaattcacgaacatctanaaatgcttgccaaaacggccggggaagtttnttgcgcggacggtcacgcccgagctggttgccgacatcagntatcttgaaattgtggtcttccaagtggancgcaactgggcctacgccatggagtgcaagntggacactgtgganaagccgnnnctgtcgcgcaaaaagtttgggatgcgacaaaagttgcgcaaagccgtcanatgggccanntttttggantcgcttgtggaagacaatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 398 - DNA, 1257 bp, Artificial Sequence
  Description of Artificial Sequence: Synthetic polynucleotide
  modified_base (1)..(273): a, c, t, g, unknown or other
  modified_base (424)..(564): a, c, t, g, unknown or other
  modified_base (757)..(1257): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctcccaacgcgcacaaccctttctccagtgtgtgcccctgaaagagccccgtccaaaccgggccgacaccctcgccatgaaccccgagctggccggccatgacacctacaacctggtgtttattgatgtctccgccgactccaccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaggaaaccctggaccggggcgagcacgagttcatcctggactgggcctgccaattctacgagccggacgaccccaaattcgtcgacttctccaagtgcatttttgagcatgccattgagacgcgccagctggagcaattgcactccactcgacacttccacacactcgccttttacatgttgatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 399 - DNA, 1293 bp, Artificial Sequence
  Description of Artificial Sequence: Synthetic polynucleotide
  modified_base (1)..(495): a, c, t, g, unknown or other
  modified_base (562)..(564): a, c, t, g, unknown or other
  modified_base (723)..(723): a, c, t, g, unknown or other
  modified_base (787)..(792): a, c, t, g, unknown or other
  modified_base (973)..(1293): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatattttgtgaagcttcctaatttcctaagcattgatacgaagccatttgatccagagacatatnnngatgatgaattggaagaggatgaagtgctagatgacgaaggcaaatctcgcttgaaactcaagatggaaaacaccataagatggcgcatcgttaaagatgaaaatggaagcgaaaagaaggagagcaatgctcgcattgtgcgctggtctgatggatgnatgtcactttatttggggaatgagatattcgaagtggaaaagcagaaaattatggatttcaatnnnnnncacttgtacattcgtcaaggagctgccttacaagctcagtcggtttttagcgaaaagttaatcttccgtccgcactcaactgagacactgacacatcgcaaaatgactttaaacatggcggagaagaccagtaaagcacagaaagtgagaatgctcgctgttgttggcgacaatccggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 400 - DNA, 1479 bp, Artificial Sequence
  Description of Artificial Sequence: Synthetic polynucleotide
  modified_base (166)..(195): a, c, t, g, unknown or other
  modified_base (624)..(624): a, c, t, g, unknown or other
  modified_base (789)..(789): a, c, t, g, unknown or other
  modified_base (993)..(996): a, c, t, g, unknown or other
  modified_base (1000)..(1002): a, c, t, g, unknown or other
  modified_base (1071)..(1071): a, c, t, g, unknown or other
  modified_base (1101)..(1101): a, c, t, g, unknown or other
  modified_base (1134)..(1134): a, c, t, g, unknown or other
  modified_base (1164)..(1164): a, c, t, g, unknown or other
  modified_base (1474)..(1479): a, c, t, g, unknown or other
atgtcatatttttgcgcgataagtggacagcaaccagagatgccagttgtctctccagcctctggttgtgtgtttgaaaagcgtttaatcaccaaatacatcgaggagaatggtacagatccggttaatggtgagaaattggacattgaccaggtaataacattgnnnnnnnnnnnnnnnnnnnnnnnnnnnnnntcactgaacacttcttcacttccatctttgttgaaacaactgcaagaagaatgggatgcgacaatgttaaacaactttactcttcgccaagaattgaagaacgttcgtgaagaattgacacatgctttgttccagaatgatgctgcatgccgggttattaatcgtcttagcagcgaactgcaacaggcacgacaaataattgcaaccctgcagggacgccggaatgttgaaagtgaagcagaggtgactgatgttgagatgcaccaagaagaggaagagggaaatggactttccggaataaatgaagagaaaagtcaggaattctcaattgctcgcaaacaacgtggtaaaaatttgcccgaaggattagctcagttggaggaagttgagaaatatgtcgagaccaaatgccatgacgcattgcacagngccagcaatcctgggattactgctctcgacttacagaaacacttcattatcactggaggtcaggacaagacaattgtgctcttcaattaccaaactgagacaattgaaaacacatataaaggacaccagaaacggatcaatgcggttcgtcttcatccgaacctncagacaatcatttctggagcacaagattcaaacattcgtatatggtcaacaaatgagactagtgcgcgctatgttattgcgttgcacgacaatgccattactgatgtttctcttcacccaaccggagagcatttcttatgcacgtctgaagattctcactggtccctgatcgatctcaacgcaggacgtcctctcataaaggtnnnntatnnnggcgatgatgacaatgggttgcgatgcgggcaattccatccagatggtctgatatttggaactggttcnaagagttccatcgtcaaaatatgggacatnaaggaacaaatcaatgtcgctcaattcccaggncatcaggattccgtttgcgcaatttctttntcggagaatggttattacttagccactggttcggtggatggagaagtcaaaatctgggatctcagaaaattgaagaatttgaagacgcttgttcacaacacaaaggacgcggttaatgctctcacattcgaccagtccggagcttatcttgctgttgcttcttcaagtgcacatgttttccaagtgaaatcgtggaacaagatcgctcagttcaacacgcatacccaagcagtcactggcgtttgtttcggagagaatgctaagttcattgcaacgagcagtttggacaaaactgtccgcatgttttcgnnnnnn

SEQ ID NO: 401 - DNA, 1452 bp, Artificial Sequence
  Description of Artificial Sequence: Synthetic polynucleotide
  modified_base (1)..(585): a, c, t, g, unknown or other
  modified_base (612)..(612): a, c, t, g, unknown or other
  modified_base (636)..(636): a, c, t, g, unknown or other
  modified_base (648)..(648): a, c, t, g, unknown or other
  modified_base (651)..(651): a, c, t, g, unknown or other
  modified_base (712)..(1452): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaagtgcctcttcgtgtccgttangcccgtcccgacagcgacatccanaagcggcggcgngancagtcggcccttttcaagcaaaagcaggttgaccaggaccagtggataccactccgggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 402 - DNA, 2073 bp, Artificial Sequence
  Description of Artificial Sequence: Synthetic polynucleotide
  modified_base (1)..(795): a, c, t, g, unknown or other
  modified_base (919)..(2073): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggagggtgttcatttgcccgaattctatccgcttaccaaaagtgaagagcgcgaattgaaacggatccggcgcaaaatacgcaacaagaagtccgctcagacaagtcgaagaaggaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 403 - DNA, 1722 bp, Artificial Sequence
  Description of Artificial Sequence: Synthetic polynucleotide
  modified_base (1)..(159): a, c, t, g, unknown or other
  modified_base (265)..(265): a, c, t, g, unknown or other
  modified_base (268)..(269): a, c, t, g, unknown or other
  modified_base (273)..(273): a, c, t, g, unknown or other
  modified_base (288)..(288): a, c, t, g, unknown or other
  modified_base (303)..(303): a, c, t, g, unknown or other
  modified_base (312)..(312): a, c, t, g, unknown or other
  modified_base (315)..(315): a, c, t, g, unknown or other
  modified_base (319)..(319): a, c, t, g, unknown or other
  modified_base (348)..(348): a, c, t, g, unknown or other
  modified_base (350)..(350): a, c, t, g, unknown or other
  modified_base (354)..(354): a, c, t, g, unknown or other
  modified_base (366)..(366): a, c, t, g, unknown or other
  modified_base (373)..(373): a, c, t, g, unknown or other
  modified_base (415)..(420): a, c, t, g, unknown or other
  modified_base (601)..(726): a, c, t, g, unknown or other
  modified_base (801)..(801): a, c, t, g, unknown or other
  modified_base (871)..(873): a, c, t, g, unknown or other
  modified_base (912)..(912): a, c, t, g, unknown or other
  modified_base (1001)..(1001): a, c, t, g, unknown or other
  modified_base (1036)..(1722): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcaccccattcttttgtgattcacaccggacgtgttgggcgatatgtgcgccaacttgagagtgatttacgccgtgtaatgagcccgcatacttccaaagaanttnnggtnacaaagcggaataanttcaaggattttgtngtaaattcncantatntgggcgtttcccacctcttggttctgacnanaacngacatttccgtnaattttngcatcattcgcaatccgcaaggaccaacgcttcatttcaaannnnnnaaatattgcctggcccgcgacatccttgcctcgcagaagcggccccttgtctatgaagaactcttcgaacatcctcccctggtcattctgaacgggtttgccgctgaggacaaacggcacctccaattggtgcaaaccgttgtgcagaacatgttcccggccatcgacgtcgacaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaccaaaaaattgttgcaaagcaaaatcccggatttgtccaaatatgaggacatcagcgactttatgctcganccgggacaactcagcgacagcgaattcgagggagaacaagtggaattggagttgccccaagactttggcnnnggtcgaggcaagaagaaggggcagcgcacaaaactaganctcctcgaaatcgggcccagaatgagcctgaggttgaccaaaattgaggagggcataaacgatggcgaagtgctctaccacgcgtttgnggagaaaagcacaaaggaaattgcgcaacttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 404 - DNA, 2613 bp, Artificial Sequence
  Description of Artificial Sequence: Synthetic polynucleotide
  modified_base (1)..(741): a, c, t, g, unknown or other
  modified_base (1233)..(1233): a, c, t, g, unknown or other
  modified_base (1312)..(1458): a, c, t, g, unknown or other
  modified_base (1633)..(2142): a, c, t, g, unknown or other
  modified_base (2301)..(2301): a, c, t, g, unknown or other
  modified_base (2475)..(2475): a, c, t, g, unknown or other
  modified_base (2554)..(2613): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctggatcgactcgaggcttatgtgaagacggccattgaaaagggcgagaatcttgaccgaaagcttttggattccctactcggcgccatcaacatccaagtgcaaaaagagccctactctgtgcgcaaacttatcctcgaaaagcaattgatattgcccaacaccatttccattccgccgagtcagattgtagacatggttattgagcacgatccagagtatcaattgtctcgtgtgatcacgcgcttgtttggcgaagagcggccaaaattgacggacaacgaacgtcgcgaacggcaaattttaaaagcattgcatccggcgccgaatatgacacgcgtattgctcgaaattgggcaggatttggtccaagaatgcacctattatgacattgttcatgcgagaaatttgccagaaatgccaaagaacatggagacgtacaaacaagttgctgctcaactcaaaccagtatgggaagcattgaaaccnaaaaattcgcctcataaaatgaaagttctgaattgccatgtctgcggcttcaaaacggacagtcgaacagttagtagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgcccaatctgtgaggaggatttccactacaaagtgcaaagagatcaccatttgaagatgtgtcgtcgtgatgtgaacaaactgcgtacaatccaagctggacgcgccccagagcatatagctgtgaaccgttggctttgggataaaccgcccgttgagccgtccatcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgagatttgcgacgaccaaatgcccacgaaggaaagctatctggcccatctccagacaaagcacaatcaaatgcatggcaaaaaggccgcagacattggccagggcgctccactggcgtgcagccgttgcagagagcgcttttggacttacgaaganttggaacgccacttggtgatgtcccatgggcttgtcacttccgacttgttggcaaaggcacaacgaaaagtcgacagtggacgatgcaaactctgcagcaagcaatacgcattcaaccttctccaacacttggttaatgatcactctgttaagctatgcagcgccgaaatcgtntattcttgtgacgtttgctcatttaaatgctcttcatacaaaaaactggaaacccatttggcagagacacacccgaagnnnnnnnnnnnnnnnnnnnnnnnnnnnnnnnnnnnnnnnnnnnnnnnnnnnnnnnnnnnn

SEQ ID NO: 405 - DNA, 2385 bp, Artificial Sequence
  Description of Artificial Sequence: Synthetic polynucleotide
  modified_base (1)..(204): a, c, t, g, unknown or other
  modified_base (248)..(249): a, c, t, g, unknown or other
  modified_base (251)..(252): a, c, t, g, unknown or other
  modified_base (259)..(259): a, c, t, g, unknown or other
  modified_base (270)..(270): a, c, t, g, unknown or other
  modified_base (279)..(279): a, c, t, g, unknown or other
  modified_base (285)..(285): a, c, t, g, unknown or other
  modified_base (293)..(293): a, c, t, g, unknown or other
  modified_base (302)..(303): a, c, t, g, unknown or other
  modified_base (318)..(318): a, c, t, g, unknown or other
  modified_base (363)..(364): a, c, t, g, unknown or other
  modified_base (571)..(882): a, c, t, g, unknown or other
  modified_base (1012)..(1029): a, c, t, g, unknown or other
  modified_base (1104)..(1104): a, c, t, g, unknown or other
  modified_base (1107)..(1107): a, c, t, g, unknown or other
  modified_base (1137)..(1137): a, c, t, g, unknown or other
  modified_base (1146)..(1147): a, c, t, g, unknown or other
  modified_base (1152)..(1152): a, c, t, g, unknown or other
  modified_base (1155)..(1155): a, c, t, g, unknown or other
  modified_base (1185)..(1185): a, c, t, g, unknown or other
  modified_base (1203)..(1203): a, c, t, g, unknown or other
  modified_base (1225)..(1716): a, c, t, g, unknown or other
  modified_base (1798)..(2181): a, c, t, g, unknown or other
  modified_base (2380)..(2385): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatattcacaaaaaatccgagattcaaattgaaaattttaattnntnncagattntgcacgagctngacgacaantacaantcggtggncgacaaganntcctctctgcacgangcctgcgaccgcatgatgtccgagcaaacccaactggcggcggcnnacgagaaaatcagcgcaagtctgcactactaccagcagtacgagtggctgcttaagaaactggccaccccaaagctgtcgctgtccggcactctgttcacccaaatcctgtccgccatccacgagtgcatcacctatctgcgcgcccaccccgagcagcgcgaggccgaccagtacttgcacaagtacgagcagtgcttgagtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgccaacgccaccaaaactcctcgtgcaccctgacccgggacagttgcacatttctgctgcgcctgtgcgacgacgagttccgactttatcgccaattttttgtgatcaacggtgggaatgaccggnnnnnnnnnnnnnnnnnnagactccatgacgccctcatccccgtccattttcccttttggcccctccaatcggcccaacagtccaaccagttngangcattcatcgagggcctttgccgcattctntacgacacnntgcgnccnctcatcatccacaacccgcacttggagacnctggcccagctgtgcacncttttgaaggtttattttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccgtgcgctggacgccgagctgttcattgtgaagcacctgctcatcctgcgcgaacagaccagcccctatcgacagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttttccaggtgcgcgccgcattttccctctacgtgggcgtccgtgagaccgaagacattctgctccagcccatccgtcgtgcggtgggcaacgccttttccgcactcaaccagtttgctgagcgccactacggggaggagcagcggcaggtgatttcggcacccggccaggagcaaatttggcttatcctcaacnnnnnn

SEQ ID NO: 406 - DNA, 1101 bp, Artificial Sequence
  Description of Artificial Sequence: Synthetic polynucleotide
  modified_base (1)..(129): a, c, t, g, unknown or other
  modified_base (132)..(132): a, c, t, g, unknown or other
  modified_base (348)..(348): a, c, t, g, unknown or other
  modified_base (415)..(415): a, c, t, g, unknown or other
  modified_base (472)..(472): a, c, t, g, unknown or other
  modified_base (505)..(573): a, c, t, g, unknown or other
  modified_base (628)..(630): a, c, t, g, unknown or other
  modified_base (696)..(696): a, c, t, g, unknown or other
  modified_base (732)..(732): a, c, t, g, unknown or other
  modified_base (744)..(744): a, c, t, g, unknown or other
  modified_base (765)..(765): a, c, t, g, unknown or other
  modified_base (783)..(783): a, c, t, g, unknown or other
  modified_base (798)..(798): a, c, t, g, unknown or other
  modified_base (867)..(867): a, c, t, g, unknown or other
  modified_base (874)..(874): a, c, t, g, unknown or other
  modified_base (960)..(960): a, c, t, g, unknown or other
  modified_base (987)..(987): a, c, t, g, unknown or other
  modified_base (1084)..(1101): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgntgggatgtgcacgcctatgggcaccacatcaaaatccacgtggtcaaccaaagcgccgacgggatggacctggactttgacttgatcaacgtggaagcgcccattgccaacgcactgcgacgcattctcattgccgaggtgccaacaatggccattgagaaggtctacttgtatcagaacacatccgtcattcaggacgaagtgctgtgccatcgncttggtctcatcccaatccacgcggacgccacaaaatttgcattccccgttcaaaagccgccccaantgaatcagccaaacacggacgttgatcaggagcctccgggcgacccaaaagtgaatntggtgtttgaattgcatgccgtttgtcccaggnnnnnnnnnnnnnnnnnnnnnnnnnnnnnnnnnnnnnnnnnnnnnnnnnnnnnnnnnnnnnnnnnnnnnagtttcaaatggattccaattggcgaccaaaaggcccgtttctcgaaggatttgnnncctcgcctggttcacaatgacatcattctggcaaaaatgcgaccaggccaagagattgaggccagntgccattgtgtgaagggaatcggccgggaccatgcnaaattctcgccngttgcgaccgccacttaccgnatgctgccgcaaattcgnctgaaacggaacttngacgaggaccaggcggaacggctgcaatccagcttctcaaaaggcgttattggacgtgagaagggcagnttcaatntttaagtttacgtcaaagatgctcgcaaagacacgtccagtcgaaatatcttccggcatgaggacctgaaagacgcagtggaaatnagcaagaagaaaacccatttcatttcnagtgtggaatcagttggcgcagccccagccgacaaactcgtcattgaggcgtgtgccatcatgaaggacaagatggagttgttgcgaaggcacattnnnnnnnnnnnnnnnnnn

SEQ ID NO: 407 - DNA, 543 bp, Artificial Sequence
  Description of Artificial Sequence: Synthetic polynucleotide
  modified_base (163)..(543): a, c, t, g, unknown or other
atgggtcttgcaatcagcggattgttcagccgtcttttcggcaaaaaacaagtcagaattctcatggtcggattggatgctgccggcaaaaccacgattctttacaaacttaagctcggcgagattgtcaccaccatcccaaccataggtatttctatgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 408 - DNA, 2517 bp, Artificial Sequence
  Description of Artificial Sequence: Synthetic polynucleotide
  modified_base (1)..(24): a, c, t, g, unknown or other
  modified_base (168)..(168): a, c, t, g, unknown or other
  modified_base (243)..(243): a, c, t, g, unknown or other
  modified_base (393)..(393): a, c, t, g, unknown or other
  modified_base (454)..(456): a, c, t, g, unknown or other
  modified_base (507)..(507): a, c, t, g, unknown or other
  modified_base (525)..(525): a, c, t, g, unknown or other
  modified_base (528)..(528): a, c, t, g, unknown or other
  modified_base (531)..(531): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (558)..(558): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (578)..(578): a, c, t, g, unknown or other
  modified_base (582)..(582): a, c, t, g, unknown or other
  modified_base (585)..(585): a, c, t, g, unknown or other
  modified_base (589)..(592): a, c, t, g, unknown or other
  modified_base (597)..(597): a, c, t, g, unknown or other
  modified_base (613)..(615): a, c, t, g, unknown or other
  modified_base (696)..(696): a, c, t, g, unknown or other
  modified_base (754)..(756): a, c, t, g, unknown or other
  modified_base (859)..(861): a, c, t, g, unknown or other
  modified_base (1006)..(1095): a, c, t, g, unknown or other
  modified_base (1210)..(1518): a, c, t, g, unknown or other
  modified_base (1657)..(1926): a, c, t, g, unknown or other
  modified_base (2197)..(2517): a, c, t, g, unknown or other
nnnnnnnnnnnnnnnnnnnnnnnncaaaatctaatacctctgatcaatcggatccaggatgctttcacacaaatcggcacaactccaaacatcgacttgcctcaaattgcagttgtaggcgggcaaagctccggaaaatcttctgtgctcgagagtttcgttggaaangattttctaccccgtggcagcggcattgttacccggcggcctctaatccttcaattggtcaacgatgcaaacgantacggcgaatttttgcataaaaaaggccacaaatttgtcgacttcgaccagatacgaaaggaaattgaagatgaaacagatagagtgaccggcgccaatcgcggaatttcaccaattccaattaatctttgtgtgtacagtccacatgtnctcaatttgactctcatcgacttgccaggaatgaccaaagttcccgtcggtgatcaaccgnnngacattgaacaacaaattcgtgacatgatcctcacatatattgccaggganacttgtctgattttggcngtnacnccngcnaanagngatttggccacttcngatgcactnaanctggcnanggangtngacnnnnaaggnttacggacaattggtnnnctgaccaaattggacttgatggatgagggcaccgatgctcgggacattttggagaataggctgttcccattgcgaagagcntatgtgggtgtgatcaatcgcagtcaaaaggacattgttggacgcaaagatattcgtnnngcattggatgccgaacgcaaattcttcctctcttcaccgtcctataggcatatggccgaaagaatgggcactccatatttgcaaaaaacactgaatcaacagnnnacaaatcacatcaaagacactctgccagcattgcgggacagtttacaaaagaagctgtattcaatggaaaaggaggtggccgaatacaagaatttccaattcaatgacccatcgcgaaaaacaaaggctttgatgcagtcagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgccttttccatgaacgtttcccattcgaaattgtcaaaatgaccattgatgagaaggaaatgcgccgagaaatccaatttgccattcgaaatatccacggcattcggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcttccacgaatacaaagaagaatttgggcaatcaagtgattcggaaaggatggctttcggtccacaacatcagttttgtgcggggttcacgcgagtgttggttcgtgctgacttccgaaagtctttcctggtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagcatggacccacaattggagcgtcaggtggaaacaatccgcaatttggtcgactcctacatgcgaatcatcacaaaaacaattcgcgatttggtgccaaaagccattatgaatttgattgtcaataagatggctgactttttgcgcgatgaactgttggccagtttgtatcaagggggtgacacggagcaattgatggaggaatcaccgctggaggcacagaaacgtgaggagatccttcgcatgtatcattcttgcaaggaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 409 - DNA, 1422 bp, Artificial Sequence
  Description of Artificial Sequence: Synthetic polynucleotide
  modified_base (1)..(3): a, c, t, g, unknown or other
  modified_base (156)..(156): a, c, t, g, unknown or other
  modified_base (354)..(354): a, c, t, g, unknown or other
  modified_base (457)..(795): a, c, t, g, unknown or other
  modified_base (1008)..(1008): a, c, t, g, unknown or other
  modified_base (1162)..(1422): a, c, t, g, unknown or other
nnntcagtaaaattcctcgaatttgtaaagcctttttgtgggtttgtgccggaagtttccaagccagaaaggaaaattcaatttcgtgagaaaatgctctggacggcgattacattgttcgtcttccttgtttgctgccaaattccactttttgtnataatgtcaacggacagtgcggatcccctctattggctccgagtaattatggcatcgaatagaggaactctgatggaattgggcatttcaccaattgttacctccggtctaataatgcaattgttggctggcgctaaaatcatcgaagttggagacacgccaaaggagcgggcattgtttaatggagcacaaaaatanttcggcatggtcatcacaattggacaggcgattgtctatgtggcatccggaatgtatggaaatccgcacgaaattggcgctggtatttgcttgttgatgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatcaaaagtgcccgttaccgtggccaacacagctcctacccaatcaaattattctacaccagcaacatcccaatcatccttcaatctgcgctcgtctccaatctttatgtaatctcacaaatgttggccgccaaatttgggggaaatattctggtcaatttgcttggaacatggtccgattcatctggatatcgcagttatccaactgtnggaatttgctattatttgtcgccgcccgaatcattatcccacatcctggaagatccaatccattgcctcatttacatcgtttttatgcttggctcctgtgcattcttctcaaaaacttggatcgatgtgagcggttcatcggcaaaagatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 410 - DNA, 3087 bp, Artificial Sequence
  Description of Artificial Sequence: Synthetic polynucleotide
  modified_base (1)..(168): a, c, t, g, unknown or other
  modified_base (277)..(279): a, c, t, g, unknown or other
  modified_base (559)..(771): a, c, t, g, unknown or other
  modified_base (933)..(933): a, c, t, g, unknown or other
  modified_base (1126)..(1128): a, c, t, g, unknown or other
  modified_base (1230)..(1230): a, c, t, g, unknown or other
  modified_base (1470)..(1470): a, c, t, g, unknown or other
  modified_base (1636)..(1743): a, c, t, g, unknown or other
  modified_base (2098)..(2412): a, c, t, g, unknown or other
  modified_base (2764)..(3087): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaattgctttttaggaggtgttcgcaatgttactttgcacgaccaaaagcagctgaccttcaacgatttgtccgcacatttctattcttcagaggctaacattggcnnnaatcgtgttcaaacatgtttcgaaaagttagctgaactgaatgacacagtcaattgctcaatttccaccgaaccgctaactcaggatttcatcagtcaattcgatcttattgtcatcaccgatgcttcttgggaacagcaaatcactttgaacaattgggcacgaaagaatggcaagaaattcattgcggccgatgcccgtggacttttctcctatgcttttgtggatttgggcgaccaatttcaagtgaatgattcggatggcgaagcttgcaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacgcgcaaaacaagtgaaagcgcccaaaatggtcacattcaaatcattggaagctgcaatgaatgagccggaatttctcatctgggactttgccaaattcgaccaacctccacaattgcattcactctggcaggctttgtatcgctttgagaaaaaggantgacgctctccacaacctcgttcaaaggaggatgcagaacttttgaagaaagaattgctggaaggttcgccggaaattcccgaggaattgctcaacaatttttcttatcaagcaaccggaaatctgcagccaattgcctcattcattggtggttttgttgcgcaggaggcgatgaaggcgtcaccatcacacnnnaatgccttgcgccaatttctttacaccgattcatgcgaggcacttcccggggaatattccacctttgatgcggccaaattaaaaaggaggattgtgcaccgngaaattgtcgctatgaatggacaggcagcagtttttggttggccattccaggcggcattggaacgccagcattggttcattgttggggccggcgcaattggctgtgaattgctgaagaattttgcgatgatgggagcggcctgcgacaagaatggtgccttgaccataaccgatccggacacaattgaagtcagcaatttgaataggcaattcttattccgtcgaccggatgttgggganaaagaagtcagaagttgcgccaatgcagtgcaaaaattcaatccggctttgaatattcgtccattggctgaaattgtggccgaaagcactgaacaaattttccatgatgattttttccatcaactcaatggaatttgcaatgcattggacaatgtggaagcacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaggtccacttctgatccaccggagaaggaaacgccggtttgcacacttcgcaattttccataccaaatccaacacacaattcaatggggaaaagcgaaattcgttgaccatttcacatcggttgccgaaaccgtcaatcaatatttggacgatgtggccggtctgcgacgaatgaaagagcaaatgaaccaaggacaacagctggaattgttgcgaactctcaaccgtgcattgattgaagaatgcccaaaaacccgtgaggattgcgtctattgggcccgcgacctgttcgacacactctatcgaaatgacattcagcaattgctgcacaattttccaccggatcaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcacgattgaatttgggcaacattcaacgctttacgccaattgactttgagaaggacgatgacacaaaccatcacgtggatttcattacggctgcatccaatttgcgggcggataattacaacattgaaaaggcggatcgaatgaagacaaaacaaatcgccggtcgaatcatcccagcgttggctaccacaacggcaattgtctccggattggtctgcattgaattctacaaaacaattgaggcaaagggcatcgcaaaaacgccaattgaacgattcaagaatgcattcctcaatttggccactccattcatcgctttcagtgaaccagggaaggcagcaaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 411 - DNA, 1131 bp, Artificial Sequence
  Description of Artificial Sequence: Synthetic polynucleotide
  modified_base (1)..(72): a, c, t, g, unknown or other
  modified_base (163)..(537): a, c, t, g, unknown or other
  modified_base (640)..(840): a, c, t, g, unknown or other
  modified_base (960)..(960): a, c, t, g, unknown or other
  modified_base (1129)..(1131): a, c, t, g, unknown or other
nnnnnnnnnnnnnnnnnnnnnnnnnnnnnnnnnnnnnnnnnnnnnnnnnnnnnnnnnnnnnnnnnnnnnnnngcatatgttcgccaacataacattcaacaattggtgaaggatgctatcgtttccctgtgcatccacaaaccggacaaccctgttctgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgtcaatggggaatttgtattgtccatcaaggagggcggctcattcggtgaattggccctgatctatgggacaccacgggcggccaccgtcgttgccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccaacccggcgatgaattcttcatcattgtggatggcgaggccgacgtccttcaaagacccaatgatgatgccccattcgaggtggtcggcaaattgggaccatccgaatattttgcngaaattgccctcctattggatcgtccacgggctgccactgttgttgccaaaaccccattgaaatgcgtcaaattggatcgtgcccgattcgaacgtgtcatgggcccggtgcgcgaaatattgaagcgggatgttggccattacaattcatatgtgaaattgatgactnnn

SEQ ID NO: 412 - DNA, 10275 bp, Artificial Sequence
  Description of Artificial Sequence: Synthetic polynucleotide
  modified_base (1)..(333): a, c, t, g, unknown or other
  modified_base (439)..(501): a, c, t, g, unknown or other
  modified_base (697)..(1779): a, c, t, g, unknown or other
  modified_base (1892)..(1896): a, c, t, g, unknown or other
  modified_base (2104)..(2388): a, c, t, g, unknown or other
  modified_base (2515)..(2706): a, c, t, g, unknown or other
  modified_base (2824)..(2841): a, c, t, g, unknown or other
  modified_base (3109)..(3109): a, c, t, g, unknown or other
  modified_base (3169)..(3171): a, c, t, g, unknown or other
  modified_base (3409)..(3411): a, c, t, g, unknown or other
  modified_base (3847)..(3873): a, c, t, g, unknown or other
  modified_base (4042)..(5454): a, c, t, g, unknown or other
  modified_base (5482)..(5490): a, c, t, g, unknown or other
  modified_base (5635)..(5640): a, c, t, g, unknown or other
  modified_base (5806)..(6255): a, c, t, g, unknown or other
  modified_base (6436)..(6924): a, c, t, g, unknown or other
  modified_base (7153)..(7155): a, c, t, g, unknown or other
  modified_base (7431)..(7431): a, c, t, g, unknown or other
  modified_base (7675)..(8088): a, c, t, g, unknown or other
  modified_base (8158)..(8160): a, c, t, g, unknown or other
  modified_base (8215)..(8217): a, c, t, g, unknown or other
  modified_base (8389)..(8934): a, c, t, g, unknown or other
  modified_base (9310)..(10275): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaattggtcaacattcgccctgaggatattgttgagggaaatgccaaattgacacttggccttatttggaccatcattctcaacttccaagtgtctgccatcnnnnnnnnnnnnnnnnnnnnnnnnnnnnnnnnnnnnnnnnnnnnnnnnnnnnnnnnnnnnnnncatcatcaacaaccatcgtacgaaactcaagcattgacagcacgagaagctcttttggcttgggcccgtcgaatcactgccggctatccgggtgttaatgtcacaaatttttctgcgagttggaaggatggcctcgcattttgtgccattttgcatcattttcgcccagatttggtcaattgggagaaggcaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggctgaagtctctgcagaagattcttacgattattgtgaacttttgaaaattctcgaatccgaatatcagcaacttcgggaattgtccgccggtcgaatggtcgatttggnnnnnttaatcgcctttatccgtgcggcacaacttgaattggtttggatccatgaaagagaagaattggaggtgacccgaaattggagtgatgttcaacatttggacattccaatgctgcaaaattatttcaaacaattgcttcatgaaattgaattgcacgaaaaacaattcaacgatgtgcacaatcaaggtgccgccctcattaatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcattgaccgaacgttgcgcacaaatttcgcccctttggcaacgtggcgaacgcattggccgatcaattccggtgattgctttgtgcgaatacaaaagcaaggaaattcacattcggcaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcgctacaatatggttttgaacacaatgcggactgttcgtggctgggacttggacacatttttgtcaattccacccgaccaacgtgatgaaataatcaaagcattgaatgaggatnnnnnnnnnnnnnnnnnngaattggacccgaatgatccattggctcgacgattgaaggaggaattgcgcctcacaaatgaacatttctacgatttattgggtcgagcccagcgaggaccagaaccggactattccaatgaattcgaccatgccgcatcagaattgatccgaaaattcgaagaagcttggaaagtgttgagcgaaagggcacaaaaccgaattccaaatactttggatgaattggagcatcaaattcgggaacataaaatatttgaggatgcattgnaggccctggatgtggatgtatcaaatgtgaaggaattattccgtcaattgcccaatccannncccaatcaaagggccagacatgatttgatgatttcgagatgggaagaaatttgggacctttgccgaatgtacgtggaacggctgaaagcattggaaaatgtgctaaaaagtgtggacgaagtgacggatattgtgcgaaggcatgaaatcacactttcctcctttgatgatatgccggcggcattggaacgccttcgaggggtgcatgcccaattggtcgaattgaatatggttttgnnncagcaacaaagcattgtggagaatttgaacaaagacaccgcacaaattcgttcgcatgtggcacgcacacggctgggcgttcaacaccacccggatgttgatcaattggaagaaattgtgaccagtttgaccgtccgttgggacaatgtgaacagccaagtgaccgaacgactccgtgttgccgaagaggcccaacaaactcaaatggtttaccgctctcaatacgatgaggaacttcaatggttggatcgggtggaggccacaatcaacagccttcgtcggccagaggaattacggccagaagaattacaaggccaattggaccaattgacagcggaatatgcccaattacaagaacatacggccacaattgagaatatcaacaaggaagggggcaaattcattcgggatgccagaagttatgacatcaaattgnnnnnnnnnnnnnnnnnnnnnnnnnnnttccacggccaacaaatcaaagaggaattccgtcgccaagttccacagccgaagaatggtgcccaaattgttacggaggaattggaggcattgaaccgtcgatttgcccaactttcttcggtgattttggaacgaaagaatattgtgaatgttttgatccaaaattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacagcagtggacatttcttggaccgannnnnnnnnggaaatcgtttcactcttttggaggcaatcaatgccggtctattggacccagatgtgcggcatattgtttcagaacaggaccaagaaatcctctcgattgcggatgcccttgaacgtggattgttatctccggaaggtcgaatcnnnnnngaattagatggacaccatctggatttacgtgatgcacaacacaaaggattgttgacaagaagagcacgacacacaattttcgacgtgaaaggcatcagaaacacagaagccaacacaaatttgaccttcaatgaggcggctgaagccggcattattcaggtaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggccaagatatgtcccttgacgatgccctccatcggggtttgatcgatccaaacagtgaatggattgtgccatcccgtgcatctggtgttggcccaaccattgaggaaagaacacaggaaacagtgacggaaacaggacaacaattagcaccaaaaatttatccggacaaggaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtggaagaacatgaacaatcctgggcatttgattcaaatgaaggaactttcattgatttggccacaaatgaacgtatcccattggattctgccattcgttctggccgcatttcagccgatgatcttgtggccagggacactctgactggccgtgaatattccctggctgaagccgaaaaatggggaattgtgaacattcgagagggatattatttggacaaaacgnnnaacaaacgatattcattcgccgaagccgctcgccttcatcgaatttatccaactggtggagtgcccgaaaatgcagccgatgccctgcacaccacagtccgggtgcatacccgttcggaagtggcattgaaagaggcggtgagtgccggacacggaccaatggaatacaatttgaatcgttatgtccaacatcaacaatttgacccagccaccggattattcacgcatccggatgtgcaaaagcaaatgaccctgaaggaattaatcattaaaggncttttgaacccgtacagcactcgaattgtggatcgagccagtgggcaggaattacgtttattggatgcaattgagcaacatattgtggatgatgtggccggaacagtgaaagacacacaaacaaacagagtttatgattttggcacggcagtgcgaaatggccttgtgaaggaggaaccactggcagagtcggtttttgaggatcggcgaaccagccgcacatctgtggggagcggtacgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttgacccaacaagcaacatgaaattcacaattcaactccacggtgacccggtgaccacgcagacannnacaaaagttcgatccacatcacaagttcaatccgtggaattggaaccgcacgccnnntttgtgggcattgaccaaatcaaggatatgcgaaatggccgagtgatgtcattggccgatgcccagaggcttggcctggccagggtggatcgaaagggcaaacaaagcacaaaagaatatagcgcattccgttcaaacattgaattggccgtgaacaaaggcatcatggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtggatgcccgattgattgacccaagggcaaaaacggttcaaatttcggccgatcgaattgtcccattgcaaaaggccgtcgatgatgggacaattccacgcgaaattggtgaacatttacggcgagtggacaaaatgacatttgccgaggcagtgggcaaaggcctaattgacgttgcccaagaccaattcacggatccggaaagtggcaaacaaatgagcattgccgaagccgtccaacatggattaattgacacgggaacagtgaaaggggatgaacagggagagggcaggaatttggtgcgagtgatcaattccgatgaattcgatgaacgatccgggcgaattcaggtgagggaaaaggatacacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 413 - DNA, 1413 bp, Artificial Sequence
  Description of Artificial Sequence: Synthetic polynucleotide
  modified_base (1)..(18): a, c, t, g, unknown or other
  modified_base (205)..(210): a, c, t, g, unknown or other
  modified_base (391)..(543): a, c, t, g, unknown or other
  modified_base (705)..(705): a, c, t, g, unknown or other
  modified_base (796)..(1320): a, c, t, g, unknown or other
  modified_base (1384)..(1413): a, c, t, g, unknown or other
nnnnnnnnnnnnnnnnnncaccacatgaccccggtggatatgaccaccgcaacttcaaaattacaattagaggccgccgaaattcgaagcaataaaccaaattggacttcatatttacgctcccagctggttccccaaaatgaatacaatttcattgtggcattggaagcagccaaaaataaagctgaacgcgacgaagtactcnnnnnnaatcgggacccaaacaattcggcaaaatgcataattaatttaatcattgaagtggccaaagaccagctaattcgatatgttttgactattttcgatgatttattgcaagaagacaaggccagggttgaaatattccatgaatattcaagacgacaaaaacgcacagtttggtcctggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaatatatcaatacttcggttcgatgccttcaaatgatgcttcgaattgaggaatatcgccatgcatttgttgccaccgatggtgtgcccagcataatgtcagctttggatggacgggcaaatttccaattacaatatcaactaatattctgccttggntgtttatcatttaatagtaacattgcacgatatattcaaagttcgggcgttattcaagcattgggcgatattctttccgaatgttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagccattcaaaaattgatggttcacaattgggaatatttggggaagcaattggacgcggaannnnnnnnnnnnnnnnnnnnnnnnnnnnnn

SEQ ID NO: 414 - DNA, 3222 bp, Artificial Sequence
  Description of Artificial Sequence: Synthetic polynucleotide
  modified_base (1)..(294): a, c, t, g, unknown or other
  modified_base (577)..(792): a, c, t, g, unknown or other
  modified_base (1030)..(1053): a, c, t, g, unknown or other
  modified_base (1171)..(1173): a, c, t, g, unknown or other
  modified_base (1192)..(2250): a, c, t, g, unknown or other
  modified_base (2446)..(3222): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcaaaaaaatctgctcatcgccctttccattttgatgtgcatgaacagaaaattttggtcggatttgcacgtgaagttgtgccagccgaatcgccacagcaatgtttaaccgcatgcctggatgcattcgacacattcggttttgaatgcgaatcggtgatgtactatccggtggatgctgaatgtattttgaacaccgaggaccgactggatcgacccgatctatttgtggatgaacatgaggatacggtcatctatttggacaataattgtgccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaacaatcaaacacgtcgttgcattctttcggatgaacgctccaagccacttggacgagcccaacttgccgatgcccaaggctggacctaccatgaaaaaaagtgttttgcctctccaagaacttgccacaatgttccatccttcactcgcgttcctcaaatgttgctagtcggattcgcctcattcgttatggaaaatgtgccttccgtgaccatgtgcttggatcagtgcacannnnnnnnnnnnnnnnnnnnnnnnggttttgaatgcgaatcggtgatgtactatccggtggatgctgaatgtattttgaacaccgaggaccgactggatcgacccgatctatttgtggatgaacatgaggatacggtcatcnnntatttggacaataattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattgtggccttcaggacatggacaatggaacatacaaatcggtggttgtggtccaaacaaataatttgggcattcccggcttggtcacttcaatggatcagctttatgagatttcctgcaattattcgagcatgttgggtggaaaagttcaagcggccgcctcactgaacgttcaaggccctcaaccatctctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 415 - DNA, 2928 bp, Artificial Sequence
  Description of Artificial Sequence: Synthetic polynucleotide
  modified_base (1)..(81): a, c, t, g, unknown or other
  modified_base (117)..(118): a, c, t, g, unknown or other
  modified_base (134)..(134): a, c, t, g, unknown or other
  modified_base (183)..(183): a, c, t, g, unknown or other
  modified_base (186)..(186): a, c, t, g, unknown or other
  modified_base (195)..(195): a, c, t, g, unknown or other
  modified_base (199)..(199): a, c, t, g, unknown or other
  modified_base (202)..(203): a, c, t, g, unknown or other
  modified_base (213)..(213): a, c, t, g, unknown or other
  modified_base (219)..(219): a, c, t, g, unknown or other
  modified_base (225)..(225): a, c, t, g, unknown or other
  modified_base (247)..(247): a, c, t, g, unknown or other
  modified_base (261)..(261): a, c, t, g, unknown or other
  modified_base (264)..(264): a, c, t, g, unknown or other
  modified_base (279)..(279): a, c, t, g, unknown or other
  modified_base (315)..(315): a, c, t, g, unknown or other
  modified_base (324)..(324): a, c, t, g, unknown or other
  modified_base (331)..(331): a, c, t, g, unknown or other
  modified_base (333)..(333): a, c, t, g, unknown or other
  modified_base (385)..(576): a, c, t, g, unknown or other
  modified_base (588)..(588): a, c, t, g, unknown or other
  modified_base (591)..(591): a, c, t, g, unknown or other
  modified_base (597)..(597): a, c, t, g, unknown or other
  modified_base (603)..(603): a, c, t, g, unknown or other
  modified_base (606)..(606): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
  modified_base (633)..(633): a, c, t, g, unknown or other
  modified_base (636)..(636): a, c, t, g, unknown or other
  modified_base (642)..(642): a, c, t, g, unknown or other
  modified_base (645)..(645): a, c, t, g, unknown or other
  modified_base (658)..(658): a, c, t, g, unknown or other
  modified_base (660)..(660): a, c, t, g, unknown or other
  modified_base (672)..(672): a, c, t, g, unknown or other
  modified_base (681)..(681): a, c, t, g, unknown or other
  modified_base (684)..(684): a, c, t, g, unknown or other
  modified_base (693)..(693): a, c, t, g, unknown or other
  modified_base (696)..(696): a, c, t, g, unknown or other
  modified_base (699)..(699): a, c, t, g, unknown or other
  modified_base (702)..(702): a, c, t, g, unknown or other
  modified_base (705)..(705): a, c, t, g, unknown or other
  modified_base (711)..(711): a, c, t, g, unknown or other
  modified_base (714)..(714): a, c, t, g, unknown or other
  modified_base (718)..(718): a, c, t, g, unknown or other
  modified_base (720)..(720): a, c, t, g, unknown or other
  modified_base (724)..(724): a, c, t, g, unknown or other
  modified_base (729)..(729): a, c, t, g, unknown or other
  modified_base (732)..(732): a, c, t, g, unknown or other
  modified_base (741)..(741): a, c, t, g, unknown or other
  modified_base (756)..(756): a, c, t, g, unknown or other
  modified_base (759)..(759): a, c, t, g, unknown or other
  modified_base (780)..(780): a, c, t, g, unknown or other
  modified_base (783)..(783): a, c, t, g, unknown or other
  modified_base (787)..(787): a, c, t, g, unknown or other
  modified_base (795)..(796): a, c, t, g, unknown or other
  modified_base (798)..(798): a, c, t, g, unknown or other
  modified_base (804)..(804): a, c, t, g, unknown or other
  modified_base (810)..(810): a, c, t, g, unknown or other
  modified_base (819)..(819): a, c, t, g, unknown or other
  modified_base (844)..(846): a, c, t, g, unknown or other
  modified_base (897)..(897): a, c, t, g, unknown or other
  modified_base (1005)..(1005): a, c, t, g, unknown or other
  modified_base (1222)..(1557): a, c, t, g, unknown or other
  modified_base (1705)..(1707): a, c, t, g, unknown or other
  modified_base (1734)..(1734): a, c, t, g, unknown or other
  modified_base (1736)..(1741): a, c, t, g, unknown or other
  modified_base (1775)..(1775): a, c, t, g, unknown or other
  modified_base (1779)..(1779): a, c, t, g, unknown or other
  modified_base (1785)..(1785): a, c, t, g, unknown or other
  modified_base (1794)..(1794): a, c, t, g, unknown or other
  modified_base (1800)..(1800): a, c, t, g, unknown or other
  modified_base (1803)..(1809): a, c, t, g, unknown or other
  modified_base (1814)..(1815): a, c, t, g, unknown or other
  modified_base (1822)..(1823): a, c, t, g, unknown or other
  modified_base (1833)..(1833): a, c, t, g, unknown or other
  modified_base (1836)..(1836): a, c, t, g, unknown or other
  modified_base (1840)..(1840): a, c, t, g, unknown or other
  modified_base (1845)..(1845): a, c, t, g, unknown or other
  modified_base (1847)..(1847): a, c, t, g, unknown or other
  modified_base (1851)..(1851): a, c, t, g, unknown or other
  modified_base (1866)..(1866): a, c, t, g, unknown or other
  modified_base (1870)..(1870): a, c, t, g, unknown or other
  modified_base (1884)..(1884): a, c, t, g, unknown or other
  modified_base (1887)..(1887): a, c, t, g, unknown or other
  modified_base (1890)..(1890): a, c, t, g, unknown or other
  modified_base (2086)..(2928): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnaatgaagaaggagtcaggataccggtcgattgcacnnaaccaaacccaaattntcaggaatttgacaatttgtatttggatatgaatggcattatacatccntgnacccatccngaanatnngccagcaccnaaaacngaagangaaatgttcatcctcatctttnaatacattgatcgnctnttctcaattgttcgnccaaggaagctgctttatatggccatcgatggggtngcaccacgngcaaagntnaaccaacaaagaagtcgtcgttttagggcatcaaaagaggcagccgacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtgatcctntcngatgcnaatgcnccnggtgaaggngancanaaaatnatgganttnatccgncgncaacgtgcatccncntcgcatgatccnaacaccgtncantgtttgtgnggngcngangcngatttnatnatgntnggantggcnacncacgaatcnaatttcaacattttncgngaggaatttgtgccaaatcanccnaaancctgcganntntgcggncaatanggacatganctggaacattgccagggcttggctnnncgggctgaagccggtccagaccaggccgatccactgaagaaggagaaaaanttcattttcatccgtcttcccgtccttcgtgaatatttggaacgcgagctgaccatgccgaatttgccattcccatttgatttggaaagggccattgatgattgggtnatgatgtgtttcttcgttggaaatgattttttgccgcatcttccatcgctggaaattcgcgaaggtgcaattgaccggctggtgaaattgtacaaacaaatggtctatcaaactgggggatggttgacggaggatggcgaagtgaacattgaacgagtgacaatgatcatgaccgaattgggcaaagccgaggacgaaatattcaaagagagacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtcggggcggaggatgaatcggacgaagaaccggaggatggaattcgattctgggaggccggatggaaagaccgctactatcaggcaaaattccaagtgtccgagagcgatcaggaattccgaagaaaagtggcatgtgcttatnnngaaggcatcgcatggatgtttcattantnnnnnnagggttgcgccagttggacttggtattatccatnccantatgcnccattcgcntcgganttnnnnnnnatcgnnaattttnngccggacttnagnaaancaacnanaccnttcaaaccattggancagntgatgggcgttttnccngcngctagccgatcgcacattccaaccgggtggcgttctctgatgaccgaatccaactcaccaattgtcgacttttacccggaacagttcgaaattgacctgaatggaaagaaatttgcatggcaaggtgtcgctttacttccattcgtcgatgaaaaacggcttttggaggctctcactacggtataagaaacaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 416 - DNA, 2730 bp, Artificial Sequence
  Description of Artificial Sequence: Synthetic polynucleotide
  modified_base (1)..(1122): a, c, t, g, unknown or other
  modified_base (1264)..(1347): a, c, t, g, unknown or other
  modified_base (1821)..(1821): a, c, t, g, unknown or other
  modified_base (1927)..(1929): a, c, t, g, unknown or other
  modified_base (2170)..(2730): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgagaatgaatttcttcgcgacatgaacgccttgaatgttcgacaaccagacgttttaacccgcgttagcgaatatattccaacaatcattgattatgtccaaaagataattgataatggatatgcctatgtcttggatnnnnnnnnnnnnnnnnnnnnnnnnnnnnnnnnnnnnnnnnnnnnnnnnnnnnnnnnnnnnnnnnnnnnnnnnnnnnnnnnnnnnaaggatgaagcgaatgtggaaaaacatttacgcgagggtgaaggcgaactcagctgcggaattcaattattaaaggaaaaacgttcgccatcggatttcgctctttggaaggcttccaaaaatggggaaccatattgggagagtccatggggaaaaggccgacccggatggcatattgaatgctctgcgatgagttcagcagtttgcggcgacaaattagacattcacgcaggcggtttgacctcaaattttccacaccatgacaatgaaattgcacagtgcgaagcctacactgattgcaaccattgggtgaattttttcttgcattgtggcacactacgcattgaaggcttaaaaatgtccaaaagtttgaagaattttatcacaataaaagaagctcttaaaaaatacactgcacggcaactgcgcattctttttttgatgcatatttggtcagacaatttggattactgngactcaacaatggaacatgcgttgcattttgagaaattttattccgaattctttttaaatatcaaagatattgtgcgtaaaaaattgaaggaaagtgcagcagaannntataaaaaattggagcccagcgaagttgatctactaaacaggattgacacaattcgcgctgaaatccattcagccatgtgtgactctattgatacgagggcagtggtggagaaaatacgtcaattgatcggcctcattaatgtttatttgaaagaaagtgaacagcaaaaggcagagccaaattgcaatttattggccaataccgctaattatttaatacgattgttgcgcattatgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 417 - DNA, 1476 bp, Artificial Sequence
  Description of Artificial Sequence: Synthetic polynucleotide
  modified_base (1)..(3): a, c, t, g, unknown or other
  modified_base (84)..(84): a, c, t, g, unknown or other
  modified_base (238)..(411): a, c, t, g, unknown or other
  modified_base (1167)..(1167): a, c, t, g, unknown or other
  modified_base (1338)..(1338): a, c, t, g, unknown or other
  modified_base (1405)..(1476): a, c, t, g, unknown or other
nnngccgcaattgatgttaataaaggaattactggcgacaaatctgcccaaatccgtaattacaacactcaaccacatttgatntacaaaacggtgaccggtgtaaatggtccattggttatccttggcgatgtcaaattcccccaatatgccgaaattgtcaaattaactctgcctgatggaacaaaaagaactggccaagttttggaggtcaccaaagacaaagctgttgtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccaattaatccatggtcacgaatttatccggaggaaatgatccaaactggcatttccgccatcgatgtgatgaacagcattgcccgtggccaaaaaattcccattttttcggctgccggtcttccgcataatgaaattgccgcccaaattgtacgccaaggtggtttagtcaaattgcccaacaaaaaacatggagaagacgattttgccattgtttttgcggcgatgggggtgaacatggagacggcacgatttttcaaacaagattttgaggagaatgggtcaatggaaaatgtttgccttttcttgaatttggcaaatgatccaacgattgaacgaattattactcctcgtttggcattgacctgtgccgaatttcttgcctatcaatgcaataaacatgttttggttgtgctcacggatatgtcctcttatgccgaagcattgcgtgaagtttcggccgcccgtgaagaagtgcccggaaggcgtggattccccggttatatgtacactgatttggccaccatctatgaacgtgccggtcgtgtggaaaatcgaaatggttcaatcacccaaattccaattctcagcatgccaaatgatgacattacccatccaatcccggatttgaccggatacatcaccgaaggtcaaatttacgtggatcgccagctccacaatcgtcaaatttaccctccaatcaatgtgctgccttctctctctcgattgatgaaatccgccattggagacaanatgacacgggaagaccacgcggatgtttccaatcaactttatatgtgctatgcaattggcaaagatgttcaggcaatgaaggcggtggtgggggaggaggcactttcctccgatgatttactctatttggaattcctcacaaaatttgagaagaatttcatctctcaaganaattatgaaaatcgcacaatttttgattcattggacattggttggcaattattgcgaatttttcccnnnnnnnnnnnnnnnnnnnnnnnnnnnnnnnnnnnnnnnnnnnnnnnnnnnnnnnnnnnnnnnnnnnnnnnn

SEQ ID NO: 418 - DNA, 939 bp, Artificial Sequence
  Description of Artificial Sequence: Synthetic polynucleotide
  modified_base (1)..(399): a, c, t, g, unknown or other
  modified_base (937)..(939): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttttgaggcactttctgaacgtgcagtcgccgtggttgtggatccgattcagtcggtaaaaggcaaggtggtcatcgacgcattccgtacaattaatcctcaagtgattgcactcaaccaagagccaagacaaattaccagcaatattggaaatcttcaaaaaccatcaattcaggcactgatccatggactcaaccgccattattattccatcccaattgcttatcgaactagcgaaaatgaacaacagactttgctgaatttgaataaacaaagttggatggattcgatggcattggaaaaatatcatgcacattgtgccggcaacgagaaatcggtggagcaaatgttgaaattggccaaactttataagaagtccctggaagaagaagaaaagatgaccgaagagcaattggcgatcaaaaatgttggaaagcaggacccgaaacgccatcttggtgataccgttgatcaaatgttggctgacaatttggtgcaaaatctggccgccatgcttgatctttccgttttccaannn

SEQ ID NO: 419 - DNA, 2559 bp, Artificial Sequence
  Description of Artificial Sequence: Synthetic polynucleotide
  modified_base (220)..(249): a, c, t, g, unknown or other
  modified_base (438)..(438): a, c, t, g, unknown or other
  modified_base (1165)..(1182): a, c, t, g, unknown or other
  modified_base (1224)..(1224): a, c, t, g, unknown or other
  modified_base (1329)..(1329): a, c, t, g, unknown or other
  modified_base (1464)..(1464): a, c, t, g, unknown or other
  modified_base (1849)..(2361): a, c, t, g, unknown or other
  modified_base (2557)..(2559): a, c, t, g, unknown or other
atggttaacttcaccgttgacgagatccgaggtcttatggacaagaagaagaatatccggaatatgtccgtcattgcgcacgtcgaccatgggaaatcaacattgacggattcgcttgtttccaaggcaggcatcatcgctggtgcaaaggctggcgaaactcggtttacggatactcgaaaagatgaacaagaacgctgcattacaataaaatcaacgnnnnnnnnnnnnnnnnnnnnnnnnnnnnnnaaagatttggacttcgtgaagggcgacaaccaatgtgaaatgcaagaagttgatggacaaaagaagaaatacaacggtttcttgatcaatttgattgactcacccggccatgttgacttctcaagcgaagttactgccgcattacgtgtcactgatggtgctttggttgttgtggactgcgtttctgtngtttgtgtgcaaacagagactgtattgcgacaagcaattgctgaacgcatcaagccagtgctgttcatgaacaaaatggaccgtgccctactcgaattgcaacttggccaagaagagttattccaaacattccaacgcattgtggaaaatatcaacgtcattattgccacatatggagatgatgatggaccaatgggcccaattcaagttgatccttcaattggcaatgttggcttcggttctggtcttcatggttgggcattcactctgaaacaattcgccgaaatgtatgccgacaaattcggcgttcaggtggacaaattgatgaaaaatttgtggggcgatcgtttcttcaacatgaaaaccaaaaaatggaccagcacccaagaacctgactccaaacgcggtttttgccaattcgtgttggatccgattttcaaggtttttgattgtgtgatgaacatcaagaaggaagagactacaaaattggtcgagaaattgggcgtcaaattgacaaatgaagagaaagagcaagaaggaaaacctttattgaagactatcatgagaaaatggcttcccgctggtgacacatgcttcggtatgatttgcatacatttgccatcacctgtgaccgcccaaaaatatcgtaccgaaatgctctatgaaggaccacaagacgatgaagccgccattgcaatgaaaacttgcaatccaaatggcccattgnnnnnnnnnnnnnnnnnnatggtgcccacctcggacaaaggacgcttctatgctttcgancgtgttttctctggaaaagtagcaacgggaatgaaggctcgcatccaaggaccaaattatgtaatcggcaaaaaggaagacctttatgagaagacaatccaacgnacaattctgatgatgggacgttacattgaaccgattgaggatattcccgcaggaaatattgctggcttggtcggtgtcgatcaatacctggtcaaaggtggaacaatcacaacctacaaagatgctcataacatncgtgtcatgaaattctccgtctcgccggttgtgcgcgttgctgtcgagccaaagaacgcaggagatttgccaaaattggtggaaggtttgaaacgtttggccaaatcggatccaatggtgcaatgcattttcgaggaatccggcgaacacattatcgctggcgccggtgaacttcatttggaaatttgtctcaaggatttggaagaagaccatgcctgcattccactcaagaagtcagatccggttgtgtcttatcgcgaaaccgtgaccgaggaatcggacatgatgtgcctttccaaatcgcccaacaaacacaatcgtctgttctgcaaggcaaaaccacttccggatgggttggccgaatcaattgagaagggcgatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaggcttcaccgccgatctccgctccaacaccggcggtcaagcattcccacaatgcgtgttcgaccattggcaaattttgcccggcgatccattcgaggccaactcacgtccggcccaagtggttgcagaaacacgaaagcgcaagggactgaaggaggggatcccatcgctcgataacttctatgataaactcnnn

SEQ ID NO: 420 - DNA, 762 bp, Artificial Sequence
  Description of Artificial Sequence: Synthetic polynucleotide
  modified_base (307)..(309): a, c, t, g, unknown or other
  modified_base (634)..(762): a, c, t, g, unknown or other
atggaacgctatgacagagcaatcacaattttttcgccagatggtcgtctattccaagttgattatgcgcaagaagccgtgaaaaagggttcaacagctgttgcagttaaagggaaagattgtgtggtgataggcgttgaaaagaaatcggttccgattttacaagatgatcgaaccatccgtaaaattcacgaattggacaaccacattatggccgcattttccggtttgagtgctgatgctcgcgttctcattgaccatgctcgacgtgaatgcgaatcctacaaattgacacttgaagatccgnnntcattgaaacgtatttctcgtattgttgctgacatcaaacaggaattcacacaaacgactggccgacgtcctttcggtatttctatgctcattggtggcttcgacccagatggaactccgcatctcttcacgactgagccatccggtgtttattacgaattacaagctggatccattggccgaaatgaaagagtggtcaaggaatatttggaaaagcattacaatgatgagacaatcgccaatgaggatagcacactgaaattaatggtcaaagcactttcgcctgttgtacaatctggtgcacagaatatggaaattgcggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 421 - DNA, 747 bp, Artificial Sequence
  Description of Artificial Sequence: Synthetic polynucleotide
  modified_base (12)..(12): a, c, t, g, unknown or other
  modified_base (39)..(39): a, c, t, g, unknown or other
  modified_base (87)..(87): a, c, t, g, unknown or other
  modified_base (225)..(225): a, c, t, g, unknown or other
  modified_base (349)..(444): a, c, t, g, unknown or other
  modified_base (550)..(747): a, c, t, g, unknown or other
atgtttttgacncgaagtgaatatgaccgcggtgtgaanacattttcgcctgaaggacgtcttttccaagtggaatatgcgatggangctgtgaaggttggaactaccacaattggcatccacacgaatgagggcattgttctggcatccgagcgtcgaactgtctcgcgactggtcatcgaggaatcaattcgcaaagtgtccaaggttgacaagcatatcgtngccgcctccgctggtctcatcgccgatgcacgcacttgggtggaatgcgccagaaccgaatcgcagaattacttcttcacttatggacagaaaatacgggtcgaggatgttaccatgaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccgcatctcttccatttggacccctccggaacgtacatcaaatgtttggcaaaagcgatcggcgctggcggtgacggagcagagcacacactccgagagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 422 - DNA, 4494 bp, Artificial Sequence
  Description of Artificial Sequence: Synthetic polynucleotide
  modified_base (1)..(300): a, c, t, g, unknown or other
  modified_base (427)..(429): a, c, t, g, unknown or other
  modified_base (592)..(867): a, c, t, g, unknown or other
  modified_base (1203)..(1203): a, c, t, g, unknown or other
  modified_base (1237)..(1470): a, c, t, g, unknown or other
  modified_base (1555)..(1650): a, c, t, g, unknown or other
  modified_base (1783)..(2334): a, c, t, g, unknown or other
  modified_base (2629)..(2934): a, c, t, g, unknown or other
  modified_base (3024)..(3024): a, c, t, g, unknown or other
  modified_base (3075)..(3075): a, c, t, g, unknown or other
  modified_base (3490)..(3492): a, c, t, g, unknown or other
  modified_base (3619)..(4494): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagttgtggcctatgaaattatgcaatccacccagaatagttgccctttggaaatgcacaaaatccctgtggaactttgcgatccggtattcgataaaacatgcgaaggccgaaccgaaattcccnnnacccgcgcaaaatatgataaagccaccggacatggcctgaattcgccacgggaacaaatcaatgagaggaccagctggatcgatgcctcattcctctattccacccaagagccatgggtggccgccctgcgttcattcgagaatggaacattgctggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgaatttttgccggcccttctgagttcccgggaccaaattaaaccatattcaggctataatccgcatattccacccggcatttcccattcttttgccacaaccgcttttcgatttccgcatactttggtgccaccggcccttttgttgagaaaaaagggcagcaaatgtgaattccgaaaagaagttggcggatttccggcacttcgtctttgccaaaattggtggaatgcgcaggatattgtggagaatattcggtcgatgaaattggtattgggaatggcctcacaaattgccgaggacgaagatcatattgtggttgaggacttaagaatntacattttcggtccaatgcatttcactcgtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttcgcagccataatcaatgaccaattcttgcgacttcgagattcggatcggttttggttcgaaaatcgacaaaatgggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttcttttggcacgatggtgatccatgtccgcaaccattccaagtgaacagtaccggtttggaggaatgtgtcccattcatgcgattcgatcattttactggcaatgaagttacatatattttcactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattcaatgttccccaactcagcgaccattcctaccaattcaattcggcatcggaacaagtgatgaatatgacattgacaaaggctgaatttgcggaggcccttgggatgcgtgccggcgatttattcgtgcaaaggatgttcgcatgcatggccaaggagaatgacacggtggtcacattccaggaattcttggatgtactgcgcaaattcacacaaggctcattgaaggagaaactccagttggtattcgacatgtgcgatttggacagggaaggccgggttcaaaggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctatttggaaagttatcgacaacacattgttgtgcttttcctcttttttgccgcaaatgccattgtatttttggagcgattttggttntatcgatatgaaaatgagcatcgagatttacggcgagttatgggcgttganattgccattacgcgaggtgctgccgccgccctttccttcgatatggccctaattttgctcaccgtttgccgaaatgttttgacacttttgagggaatcattcattggcgaatatttgccgttggattcggcaataacttttcataaaattgttgccatcactgccggcattttcgccaccatccacacaattggccattgtatcaatttctatcatgtggccacacaaagccaggagggacttgcctgcctttttcaggaagctgttttcggctccaactttttgccctccatttcctattggttcttccaaacattgactggaatcaccggcattttgttggtggccacaatgtccataatttacgttttttcggcgccggctgtcatgaaaagggctaccatgcatttccatnnnaacccattgctcaatgtgctcctctatgccctgaccattttgcatggattgccaaaattgctggattcacctaaattcttctatattgtattgggcccagtcatcattttcatcatggatcgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 423 - DNA, 1293 bp, Artificial Sequence
  Description of Artificial Sequence: Synthetic polynucleotide
  modified_base (1)..(105): a, c, t, g, unknown or other
  modified_base (240)..(240): a, c, t, g, unknown or other
  modified_base (541)..(543): a, c, t, g, unknown or other
  modified_base (613)..(885): a, c, t, g, unknown or other
  modified_base (1123)..(1293): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgttactgcgaccaagggtatcgaattcgaagagtttggtttgtcacgcgatcttctaaaaggaatattcgaaaagggatgggaacatccaagtccaatacaagaagcatcgattgcaattgcactctcagancaagatattctcgcacgagccaaaaatggaacgggtaaaactggcgcatattgcattccttgcattgagaaaattgatccaacgaaagaatacatccaagcaatgataattgttccaacccgcgaattggcattacaaacttctcaaatctgcgtggaattgagcaaacatctcaaaatcaagattatggttaccaccggtggcaccgaccttcgtgatgatattttgcgtctcaatgggatcgtccatttggttgttgctactccgggtcgaattcttgatctcatggagaaaggtgtgnnnccaatgtctcaatgcaagaccatcgtgctcgatgaggccgacaaattgctttcgcaagatttccaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgccaaaaaaataaccgaacttggctattcttgctactacatccactcaaaaatggcccaacatcatcgcaacagggttttccatgaatttcgccaaggccattgccgcaaccttgtttgctctgatcttctgactcgtggaatcgatatccaggcggtcaatgtggtcatcaatttcgactttcctcgcaactcggaaacttacctgcacagaattggccggtcggttaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 424 - DNA, 1704 bp, Artificial Sequence
  Description of Artificial Sequence: Synthetic polynucleotide
  modified_base (1)..(291): a, c, t, g, unknown or other
  modified_base (369)..(369): a, c, t, g, unknown or other
  modified_base (378)..(378): a, c, t, g, unknown or other
  modified_base (384)..(384): a, c, t, g, unknown or other
  modified_base (391)..(391): a, c, t, g, unknown or other
  modified_base (394)..(396): a, c, t, g, unknown or other
  modified_base (405)..(405): a, c, t, g, unknown or other
  modified_base (1054)..(1197): a, c, t, g, unknown or other
  modified_base (1302)..(1302): a, c, t, g, unknown or other
  modified_base (1378)..(1401): a, c, t, g, unknown or other
  modified_base (1527)..(1527): a, c, t, g, unknown or other
  modified_base (1624)..(1704): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaaccagcgcatttcaatcaattccatttcgaacgtgccatccgctcatatgacacacttggttatgcagaaaanccatcagcngatgcngggaatncannntttgtcggngatgtgaacaaagcaaaggaagaaggaggcaaatcgctgtttgaatcgaaaaaaaccggcgggcaaaagcggaagaaagtggtcaattatgacgcgtcggacattgatggatacaccggtccatgggcccgctatgaaaatgagaagacggtggccaaacccgacgcggaacttcaaaaggaaatggatgagattgtgcaaaagcggaagatgaagagccggattggaaggaaactggccgttgaagaattgcatttggccgaagagagcacaaaactgcacatcaaagatgacaaggactatttgggccgttcattcatggaagcaccgaaaagtgttggagtcaatcttcgtccggaccatgtgcccgaaaggtgctatccaccgacgaagcaggcccatacctatgccggacatacaaaaccggtcacagccatccgatggttccccaaaagtgcgcatatgttcctttcgtgttcgatggatggaaaagtcaaactttgggaagtttacggcaaccgaaaattgattcgcacctatacggggcataaagtgccagttaaagacatttatttcaacaatgatgggactgaatttttgactgccgcctatgataattatattaaattatgggacaccgaaacaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatatgatcgccatcttggcccagtcaattccattacatttttcgataaaaatcgtcgattcgtctcaacttcggatgataaatcacttcgcatttgggaattnggtattccagtggacacaaaaataattcaacatgctggattgcattcaatcccatcaatgacaagggcaccaaatnnnnnnnnnnnnnnnnnnnnnnnnatggacaatcgaattgtccttttccaaattgtcgatgataagcttcgatttgcacggaagaaggcattccgtggccacaacactgccggatatgcatgcaattccgatttttcaccggatatgtgnttcctaacatccggtgacgcggacggaaaaatcacaatttgggattggcgaacgcataaaattgtttcgacatggaaaggacacgacaatgtttgtnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 425 - DNA, 951 bp, Artificial Sequence
  Description of Artificial Sequence: Synthetic polynucleotide
  modified_base (1)..(207): a, c, t, g, unknown or other
  modified_base (396)..(396): a, c, t, g, unknown or other
  modified_base (841)..(951): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaacttcaacctgtgcttatctcccgctcaatggacaaattgaataatgtggcagaagaaatccgcaaaaaattcgaccatattgacgttaaaacaatttcattcgacttcacaaacgcccaattggatgattataagacaattttcaatgaacttaaccagctcgaaattggtgttttggtgacnaatgttggaatgagctatgaatatccggaacgtttcgaccaagtcgagggtggattaaagcgcttaacagacataacagtgatcaacaccgtccctacaactgtgctttctgcctttgttctcaaacaaatggcaacccgtcatcgaggcgttgtgatcaatgttgcctcctcggctgcatattttgattggttctatttggctgtttattccgcaacaaagaaatatgtctgctggctttcctcaattcttcgcaaggaatatgccgacaccggaattattgttcaaaccgtatgcccgatgatggtggccaccaaattggcaaaagtccgcaaagcatctttcttcacaccgactcccgaaaaatttgcctacgaagcagtgcgaagcattggactcattgaggagacgaccggatgccttgctcatcaaattcaggttgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 426 - DNA, 783 bp, Artificial Sequence
  Description of Artificial Sequence: Synthetic polynucleotide
  modified_base (1)..(48): a, c, t, g, unknown or other
  modified_base (139)..(139): a, c, t, g, unknown or other
  modified_base (141)..(145): a, c, t, g, unknown or other
  modified_base (147)..(147): a, c, t, g, unknown or other
  modified_base (149)..(149): a, c, t, g, unknown or other
  modified_base (151)..(155): a, c, t, g, unknown or other
  modified_base (157)..(159): a, c, t, g, unknown or other
  modified_base (162)..(164): a, c, t, g, unknown or other
  modified_base (345)..(345): a, c, t, g, unknown or other
  modified_base (415)..(435): a, c, t, g, unknown or other
  modified_base (637)..(783): a, c, t, g, unknown or other
nnnnnnnnnnnnnnnnnnnnnnnnnnnnnnnnnnnnnnnnnnnnnnnnggtcgtttgcatcagatcgattatgccgtcgaagcaatgcgtcaagggagtgcaacagtggcaattcggggcaaagatcatgcggttgtgntnnnnntnangnnnnncnnnaannnactttcatcatatcaacaaaagactttccaattggacgatcatgttgggctttccatgtcgggtctgttggccgatgggcggattttggctcgcttcattcaaggagaatgcgccagcttcaaatgggagaatcagacagccctttcaatttccgatttgcgcaccaaactcattctgaanctgcaagagaacacacaatattacggccgccgcccatttggtgttggacttctgatcattggatacgacnnnnnnnnnnnnnnnnnnnnncagcgctgaccatcaggaaatgtcgaggaagtggtggctgccgcaattggtgctcgttcacaaagtgcaagaacctatttggcgaatcatttggacgacttcaaggaggccgacctggacaacgtcatcaaacacgcccttcgagcactgaaagagacattggcaacggatgctggcaaactggatgagaatgtttgtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 427 - DNA, 648 bp, Artificial Sequence
  Description of Artificial Sequence: Synthetic polynucleotide
  modified_base (1)..(18): a, c, t, g, unknown or other
  modified_base (120)..(120): a, c, t, g, unknown or other
  modified_base (234)..(235): a, c, t, g, unknown or other
  modified_base (237)..(238): a, c, t, g, unknown or other
  modified_base (241)..(241): a, c, t, g, unknown or other
  modified_base (247)..(249): a, c, t, g, unknown or other
  modified_base (251)..(253): a, c, t, g, unknown or other
  modified_base (258)..(258): a, c, t, g, unknown or other
  modified_base (298)..(300): a, c, t, g, unknown or other
  modified_base (526)..(648): a, c, t, g, unknown or other
nnnnnnnnnnnnnnnnnnattcctactttcaaacttgttttggttggagatggcggtaccgggaaaacaacattcgtgaagcgtcatttgactggcgaatttgagaagaaatacattganacgctcggtgtcgaagtgcatccactcaccttccatacaactcgaggacagattcgtttcaatgtttgggacacagctggacaagaaaagtttggtggacttcgtgatggctannannttnaaggtnnntnnncaatngtcatgttcgatgttacggcccgtgtcacctacaagaatnnnccgaattggcatcgggatttggttcgcgtttgtgagaatattccaattgtgttggttggcaacaaggtcgacgtgaaagatcgaaaggtcaaggccaagagcatcactttccatcgcaagaagaatctccagtactatgacatctctgccaaaagcaactacaacttcgaaaagcctttcctttatttggcccgaaagctgatcggcgaccccaaccttgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 428 - DNA, 858 bp, Artificial Sequence
  Description of Artificial Sequence: Synthetic polynucleotide
  modified_base (1)..(171): a, c, t, g, unknown or other
  modified_base (382)..(858): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttctaagagtacgtcgtggatatgaagtttataaacaagtttgtgccgcctgccactcaatgaaatatattcggtaccgacatttcatcaatgcgttcatgtcagaagaagaagtcaaggcggaagctgccgaagcattgataaacgatattgatgataatggtgtcccgattcaacgtcctggactgcctaatgactttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 429 - DNA, 1308 bp, Artificial Sequence
  Description of Artificial Sequence: Synthetic polynucleotide
  modified_base (42)..(42): a, c, t, g, unknown or other
  modified_base (46)..(46): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (189)..(189): a, c, t, g, unknown or other
  modified_base (236)..(237): a, c, t, g, unknown or other
  modified_base (241)..(241): a, c, t, g, unknown or other
  modified_base (248)..(248): a, c, t, g, unknown or other
  modified_base (255)..(256): a, c, t, g, unknown or other
  modified_base (347)..(349): a, c, t, g, unknown or other
  modified_base (356)..(357): a, c, t, g, unknown or other
  modified_base (365)..(365): a, c, t, g, unknown or other
  modified_base (367)..(367): a, c, t, g, unknown or other
  modified_base (370)..(370): a, c, t, g, unknown or other
  modified_base (408)..(408): a, c, t, g, unknown or other
  modified_base (423)..(423): a, c, t, g, unknown or other
  modified_base (429)..(429): a, c, t, g, unknown or other
  modified_base (440)..(441): a, c, t, g, unknown or other
  modified_base (447)..(447): a, c, t, g, unknown or other
  modified_base (450)..(450): a, c, t, g, unknown or other
  modified_base (453)..(456): a, c, t, g, unknown or other
  modified_base (473)..(473): a, c, t, g, unknown or other
  modified_base (477)..(477): a, c, t, g, unknown or other
  modified_base (483)..(483): a, c, t, g, unknown or other
  modified_base (486)..(486): a, c, t, g, unknown or other
  modified_base (499)..(499): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (531)..(531): a, c, t, g, unknown or other
  modified_base (543)..(543): a, c, t, g, unknown or other
  modified_base (549)..(549): a, c, t, g, unknown or other
  modified_base (559)..(559): a, c, t, g, unknown or other
  modified_base (570)..(570): a, c, t, g, unknown or other
  modified_base (588)..(588): a, c, t, g, unknown or other
  modified_base (595)..(595): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (666)..(666): a, c, t, g, unknown or other
  modified_base (675)..(676): a, c, t, g, unknown or other
  modified_base (678)..(678): a, c, t, g, unknown or other
  modified_base (684)..(684): a, c, t, g, unknown or other
  modified_base (726)..(726): a, c, t, g, unknown or other
  modified_base (804)..(811): a, c, t, g, unknown or other
  modified_base (813)..(813): a, c, t, g, unknown or other
  modified_base (815)..(820): a, c, t, g, unknown or other
  modified_base (822)..(822): a, c, t, g, unknown or other
  modified_base (825)..(825): a, c, t, g, unknown or other
  modified_base (828)..(828): a, c, t, g, unknown or other
  modified_base (830)..(830): a, c, t, g, unknown or other
  modified_base (837)..(837): a, c, t, g, unknown or other
  modified_base (840)..(840): a, c, t, g, unknown or other
  modified_base (852)..(852): a, c, t, g, unknown or other
  modified_base (855)..(855): a, c, t, g, unknown or other
  modified_base (862)..(863): a, c, t, g, unknown or other
  modified_base (871)..(873): a, c, t, g, unknown or other
  modified_base (918)..(918): a, c, t, g, unknown or other
  modified_base (927)..(927): a, c, t, g, unknown or other
  modified_base (936)..(942): a, c, t, g, unknown or other
  modified_base (946)..(946): a, c, t, g, unknown or other
  modified_base (949)..(951): a, c, t, g, unknown or other
  modified_base (957)..(957): a, c, t, g, unknown or other
  modified_base (969)..(969): a, c, t, g, unknown or other
  modified_base (981)..(981): a, c, t, g, unknown or other
  modified_base (990)..(990): a, c, t, g, unknown or other
  modified_base (1008)..(1008): a, c, t, g, unknown or other
  modified_base (1014)..(1014): a, c, t, g, unknown or other
  modified_base (1029)..(1029): a, c, t, g, unknown or other
  modified_base (1048)..(1048): a, c, t, g, unknown or other
  modified_base (1053)..(1053): a, c, t, g, unknown or other
  modified_base (1056)..(1056): a, c, t, g, unknown or other
  modified_base (1061)..(1062): a, c, t, g, unknown or other
  modified_base (1071)..(1071): a, c, t, g, unknown or other
  modified_base (1086)..(1086): a, c, t, g, unknown or other
  modified_base (1095)..(1095): a, c, t, g, unknown or other
  modified_base (1107)..(1107): a, c, t, g, unknown or other
  modified_base (1110)..(1110): a, c, t, g, unknown or other
  modified_base (1113)..(1113): a, c, t, g, unknown or other
  modified_base (1117)..(1117): a, c, t, g, unknown or other
  modified_base (1119)..(1119): a, c, t, g, unknown or other
  modified_base (1126)..(1126): a, c, t, g, unknown or other
  modified_base (1140)..(1140): a, c, t, g, unknown or other
  modified_base (1146)..(1146): a, c, t, g, unknown or other
  modified_base (1149)..(1149): a, c, t, g, unknown or other
  modified_base (1152)..(1152): a, c, t, g, unknown or other
  modified_base (1155)..(1155): a, c, t, g, unknown or other
  modified_base (1159)..(1159): a, c, t, g, unknown or other
  modified_base (1161)..(1161): a, c, t, g, unknown or other
  modified_base (1164)..(1164): a, c, t, g, unknown or other
  modified_base (1167)..(1167): a, c, t, g, unknown or other
  modified_base (1173)..(1173): a, c, t, g, unknown or other
  modified_base (1185)..(1185): a, c, t, g, unknown or other
  modified_base (1194)..(1195): a, c, t, g, unknown or other
  modified_base (1200)..(1200): a, c, t, g, unknown or other
  modified_base (1279)..(1308): a, c, t, g, unknown or other
atgccagatcacctcggaaacgatatgcgcaaagttgatgangatnangataanaaaaangaaaanaaaatngaagcnctcggcgaagaagaaatcgccgctctgaaaagctacaatatggggccgtattcggaaaaattgagccaagtggaaaaagacattgaaggagcattaaagaatatcaatgcnttgtgtggcgtcaaagaaagtgacactggtttggcaccaccagcttnntggnatttggnagccgannaaatggcaatgaagaatgaacaaccgctcaaggttgcaagatgcacgaaaatcatcaaggctgaaggcccggacccgcgttacatgatcannntcaagannggaccaanantcnttgtggaacttgccaaggaagttgcgccggccgatatngaggaaggaatgcgngttggngttgatcgaannaaatancanatnnnncttccattgccagcaanaatngatccnacngtgacaatgatgnaagtnganganaanccngangtgacntatgcngatgttggtggntgcaangaacaaattnaaaaactcagngaagtcgtcgaaatgccncttcttnatccngaacgctttgtgganatnggnatagaaccaccgaaaggtgttctcttttatggaccgccggggacnggcaaaacnntntgtgcnagagcagtggccaatcgcactgatgcatgtttcattcgtgtnattggttcggaattagtgcaaaaatatgtgggcgaaggtgcccgaatggtccgtgaattattcgaaatggcaaaaagnnnnnnnncntnnnnnntnttnttngncgaagtngangcaattggtggngcncgttttnncgatggannnggcggggacaatgaagtgcaaagaacaatgttggaattgattaancaattgganggattcgannnnnnngggncannnaaggtncttatggccacnaatcgtccgganacattgganccagcattggttcgaccnggacgnattgatcgacgcgtngaatttggtttgccggatntggangcncgagnnaacattctnaaaattcatacaaancgaatgagngttgaccgaaanatncgntacnanttgattnctcgtctttgcccnaatacnacnggngcngatntncgntcngtgtgnaccgaagccggnatgtttgcnntgcgngctcgtcgcaaaatgatcacggaaaaggactttctcgatgccgtccagaaagtggtgaaaggatatgcaaagttcagtnnnnnnnnnnnnnnnnnnnnnnnnnnnnnn

SEQ ID NO: 430 - DNA, 492 bp, Artificial Sequence
  Description of Artificial Sequence: Synthetic polynucleotide
  modified_base (1)..(357): a, c, t, g, unknown or other
  modified_base (427)..(492): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggtgccggcatttttatggcaaagcataaggaccgacactattgcggcaaatgccattccaccatgnnnnnnnnnnnnnnnnnnnnnnnnnnnnnnnnnnnnnnnnnnnnnnnnnnnnnnnnnnnnnnnnnn

SEQ ID NO: 431 - DNA, 1821 bp, Artificial Sequence
  Description of Artificial Sequence: Synthetic polynucleotide
  modified_base (1)..(48): a, c, t, g, unknown or other
  modified_base (180)..(180): a, c, t, g, unknown or other
  modified_base (217)..(219): a, c, t, g, unknown or other
  modified_base (406)..(408): a, c, t, g, unknown or other
  modified_base (529)..(744): a, c, t, g, unknown or other
  modified_base (967)..(1050): a, c, t, g, unknown or other
  modified_base (1081)..(1083): a, c, t, g, unknown or other
  modified_base (1194)..(1194): a, c, t, g, unknown or other
  modified_base (1254)..(1254): a, c, t, g, unknown or other
  modified_base (1260)..(1260): a, c, t, g, unknown or other
  modified_base (1290)..(1290): a, c, t, g, unknown or other
  modified_base (1308)..(1308): a, c, t, g, unknown or other
  modified_base (1326)..(1326): a, c, t, g, unknown or other
  modified_base (1416)..(1417): a, c, t, g, unknown or other
  modified_base (1600)..(1689): a, c, t, g, unknown or other
  modified_base (1792)..(1821): a, c, t, g, unknown or other
nnnnnnnnnnnnnnnnnnnnnnnnnnnnnnnnnnnnnnnnnnnnnnnngtggtcaccgctgaaaaaatgtctggcgcagccatgtacgaattggtccgggttgggcattccgagttggtcggcgagattattcggcttgaaggcgactatgcgacaattcaagtttatgaggaaactcantccgtcacaattggcgatcccgtcttgcggaccggannnaccctctccgttgaacttggccccggcattatgagctccattttcgatggtattcagcggccattgcaggacattgcggcgatgacaactccatttatattccaaaagggaatcaatgtgaatgcattaagccgatcaaaatcatgggaatttgagccaagaaagggcgtcaaagtaggcgatcacnnnaccgggggcgatgccattggtttggtgcacgaaagtatgctggtcaaacacacaatcatggtgcccccgaatgcttgcggaacaatcaaatacattgcaccaaaggggaactacaatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccagtcactttcaaaatacagtaattcggatgcgatcatctatgttggatgcggtgaacgtggcaatgaaatgtcggaagtgttgagagattttcccgaattggaaatggaagttgatggcaaaaagacgacaattatgcaaagaaccgcattggtggccaacacatcgaatatgcctgtggccgcccgagaggcatcaatttataccggtttgtccatannnnnnnnnnnnnnnnnnnnnnnnnnnnnnnnnnnnnnnnnnnnnnnnnnnnnnnnnnnnnnnnnnnnnnnnnnnnnnnnnnnntccggtcgtctcggagaaatgcccgccgatnnnggctaccccgcctatttggccgcccgtcttgcctcattctacgaacgtgccggaaaagtgaaatgccaaggttcacccgaacgtgaagggtccgtcacaattgttggatcngtttccccgcccggtggtgattttgccgaccccgtcacttcggccaccctcggcattgtncaagtnttttggggattggacaagaaattggcccancgaaaacattttccctcnataaattggctcatttcntacagtaattatatgcgcgctctggacgattattatgagaagaatttccccgaatttgtgccacttcgaacaaaatgcaaggaaattttnnaggaagaggaagaactgtcggaaattgtgcaattggttggcaaagcctcattggccgaatcagacaaaatcacattggaagtggccaaattgatcaaagacgatttcctccaacaaaatggatacacaaaatacgatcgattctgtccattctacaaaacagttggaatgctcaaaaatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcgatttgtctacgaattgtcctcaatgaaattcaaagatccagtggcggacggggaggacaaaatcaaaaaggattatgaggatttgcatgaaaggatgnnnnnnnnnnnnnnnnnnnnnnnnnnnnnn

SEQ ID NO: 432 - DNA, 2421 bp, Artificial Sequence
  Description of Artificial Sequence: Synthetic polynucleotide
  modified_base (1)..(768): a, c, t, g, unknown or other
  modified_base (985)..(1002): a, c, t, g, unknown or other
  modified_base (1035)..(1035): a, c, t, g, unknown or other
  modified_base (1221)..(1221): a, c, t, g, unknown or other
  modified_base (1306)..(1311): a, c, t, g, unknown or other
  modified_base (1387)..(1734): a, c, t, g, unknown or other
  modified_base (1861)..(2421): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaaatggactaagctggagcacaaaggtccaatgtttgcaccggaatatgttccaattccgaatactgttaaattcaaatatgatgggaagccaatacaactttcgaaagatgctgaggaggtggcatcattttatgcgaaaatgctcgaccatgattacacctcaaaaccagtgttcaataagaattttttcaaagattggcgaagggttatcnnnnnnnnnnnnnnnnnnaagataacggatttgaaaaaatgtgatttttcngaaatgcacgcctattttctaagtgaaaccgaaaaaagaaaagccagaagcaaagaagagaaaaaggctgaaaaggaagtgaaagatcaagaggcgaaagaatacggttatgcatcgctggacgggtataaacagaaaattggcaattttcgaattgaaccacccggtctttttcgcggtcgagangaacaccccaaaatgggttgtttaaagaagagagtacgaccagaagatgtggtaatcaattgttcgccgggagtgaaaatcccannnnnnccaaaagggcataaatggaaggagattcgtcatgacaatacggttacttggctttgttcttggactgaaaatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggcaaggattccatccgctattacaatcgtgttcctgttgagaaggcggtgttcaagaatttgaaaatattcatggaaagcaaggaacccggggatgatttattcgaccgattggatgtttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 433 - DNA, 1140 bp, Artificial Sequence
  Description of Artificial Sequence: Synthetic polynucleotide
  modified_base (1)..(27): a, c, t, g, unknown or other
  modified_base (204)..(204): a, c, t, g, unknown or other
  modified_base (352)..(564): a, c, t, g, unknown or other
  modified_base (705)..(705): a, c, t, g, unknown or other
  modified_base (724)..(726): a, c, t, g, unknown or other
  modified_base (790)..(792): a, c, t, g, unknown or other
  modified_base (965)..(966): a, c, t, g, unknown or other
  modified_base (1138)..(1140): a, c, t, g, unknown or other
nnnnnnnnnnnnnnnnnnnnnnnnnnnggttgcaactttttccggcaaaatattatttattcattgttgagtggatgcacaattaaaatcgaaaatattcgtaaatatgatgaaccacccggatttagaggtttcgaacgaaaattcctttccattattgaccaaatcacaaatggaaccgaaattcgaattaataaatcagtnactcatttacaaatgaagccaggaatattgaatggaaatgaaattgaagtggattgtggcatcgatcgatgcattagttattttttggaaccattgatgttgattgcaccattttgcaaatatccactgaatttacggctaaaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgtggttttgcatatgttagtaaagtgtccccatcaattgcttccagaatgattgaaggtgcaaagaaaatgttgcatggatatatagccgatgtttatataacaattgaccaaaggaagggacaacaaggcggattntcacctggttttggaatannnttatttgccgaaacaactgaaggtgttttctatcatggagaggcgatgtcccacccgaaaggannntcaaatgaacaaaaaataccggaagaagttgggcaaatggcagcaaagaggctattaacagaaatttataagggtggatgcactgattcctcggcacaatcgttggcagcgacatttatgactttatgcgacaaagatgtctccaaattcctcctcggacctctgacaatttnnagtgttcacactttgcgaaatttgaaatttttttcaatcattcattcaaattggacgaattttggaaaattgaaatgaagtgaaaaaaagaaattgcagacaggaagtgaagataaatgcttgttgacttgtaccggaattggatattataatattaacaaaaatatactcnnn

SEQ ID NO: 434 - DNA, 3582 bp, Artificial Sequence
  Description of Artificial Sequence: Synthetic polynucleotide
  modified_base (187)..(234): a, c, t, g, unknown or other
  modified_base (489)..(489): a, c, t, g, unknown or other
  modified_base (703)..(957): a, c, t, g, unknown or other
  modified_base (1105)..(1602): a, c, t, g, unknown or other
  modified_base (1683)..(1683): a, c, t, g, unknown or other
  modified_base (1776)..(1776): a, c, t, g, unknown or other
  modified_base (1794)..(1794): a, c, t, g, unknown or other
  modified_base (1803)..(1803): a, c, t, g, unknown or other
  modified_base (1806)..(1806): a, c, t, g, unknown or other
  modified_base (1951)..(2211): a, c, t, g, unknown or other
  modified_base (2322)..(2322): a, c, t, g, unknown or other
  modified_base (2386)..(2532): a, c, t, g, unknown or other
  modified_base (2580)..(2580): a, c, t, g, unknown or other
  modified_base (2586)..(2586): a, c, t, g, unknown or other
  modified_base (2601)..(2601): a, c, t, g, unknown or other
  modified_base (2604)..(2604): a, c, t, g, unknown or other
  modified_base (2616)..(2616): a, c, t, g, unknown or other
  modified_base (2664)..(2664): a, c, t, g, unknown or other
  modified_base (2700)..(2700): a, c, t, g, unknown or other
  modified_base (2739)..(2739): a, c, t, g, unknown or other
  modified_base (3013)..(3015): a, c, t, g, unknown or other
  modified_base (3040)..(3582): a, c, t, g, unknown or other
gtgcatgatgatgatgaagaagttgatcaggaagctcatcaagctgtggtactggatgaagacgacgaaatttcaacagaattatggcaagaagcatgttgggttgttatatcggcatattttgatgagaagggtttagtgcggcagcagcttgacaggttcgaaaatagggataaattaaaagtannnnnnnnnnnnnnnnnnnnnnnnnnnnnnnnnnnnnnnnnnnnnnnncaacattcagctggagaaattgaagcgcccacaaaattctcgctgaaatttggtcaaatctacttgtcaaaaccaacacattgggagaaggagggtgcaccgacaccgctgatgccaaatgaggctcgactccgcaacttgacctattcatctcctctttatgtggatattgtcaaaacaatctcaaggaaggaagaagatattgtgcaagaatatccgaaagttttcattggcaaaattccaattatgctacgntccagctattgtgttctctccaatttgactgatcgagatttgactgagttgaatgaatgcccattggaccctggcggctatttcataataaatggaagtgaaaaagtgttgattgcgcaggagaagatggcaacaaatacagtttatgtgtttgcaatgaaggatggaaaatacatgtataaaacggagtgccggtcatgtttagaacattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcagtggctctgaatttcatcggcacccgaggggcaaaaccaggcgttaccaaagaagcacggattagatatgcaaaagaaatactccaaaaggaaatgttgcctcatgttagcattgctgaacattgtgaaacgaagaaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggcctatatttcggttggttcaatgccagaaccaattttggaatttttggaagaatggagtatggaaaatttggaaaangtttcaccgttggcaattgcaaatagcacaaaaatatttgtgaacggttcatgggttggcattcatcgagatccggaccaattgatgacaacncttctcaaattgcgacgncaaatgganatnattgtcagtgaagtcagcatggtccgggacattcgtgatcgggagattcgaattaacactgacccgggacgagtttgccggccattgttgattgtgagtgatggaaaattgatgctcaaaaaacgacacattgaattattgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatgggcgtttacacaacaaatttccacgttcgaatggacacattggcccatgttctttattatccgcagaagccgctggtcaccacacgttcaatggaatatttacgnttcaatgaattgccggcgggcataaatgcaattgtggccatcctctcctacggtggatataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgcggcatgcactttacgaaaaattggatgatgatggaattatntcgccnggcactcgtgtttcnggngatgatgtgatnattgggaagacaattgcaattccggaagtggaaaatgaattggaggcnacggcggccagatatcagaaaagggatgcatccacncaattgcggagcagcgaaacgggaattgttgatcaagtnatgatgacattggataaggatggcaataaattcgtcaaaattcgagtccggtccattcggctgcctcaaattggcgacaaatttgcctcgcgccacggccaaaagggcacaatgggaatgatgtaccgggaggaggacatgccattcactcgggagggaattacaccggacatcatcatcaacccgcatgccgtgcccagccgaatgacaatcggccatttgattgaatgtttgcaaggaaagttgtccgcaaataaaggcgaaattggtgagnnncaccccttcaatgatacggtcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 435 - DNA, 2124 bp, Artificial Sequence
  Description of Artificial Sequence: Synthetic polynucleotide
  modified_base (1)..(663): a, c, t, g, unknown or other
  modified_base (952)..(954): a, c, t, g, unknown or other
  modified_base (988)..(990): a, c, t, g, unknown or other
  modified_base (1246)..(1599): a, c, t, g, unknown or other
  modified_base (1732)..(1878): a, c, t, g, unknown or other
  modified_base (1996)..(2124): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgcgtcacactaggcatcattcccatcatcaaatgcccaaagaataatgcagcagagagagttgccgagaaattggaccaaaaaattcgagataatttgcgcgatgcccgcaacaatttattcgtccaagagaatgtccgggccggtcatttgaacatccataggcctgttttggttattgccgaccggggaatggatttatccacaatgctgcatcatacatggacatatcaggcaatgattgcggacattttggatatggacttaaatcgagtgcggatgaagnnngacaaaaatggtcgaccgaaagattttgaattcnnnaacagcagcgaagataaattgtggagcggattcaagggaagttcattcccattggtcgccgaagccattcaagaggatttggaagcttaccgaaagaatgaggacgaaattaaacgactaaaggacacaatggtttttaatattggatttgatccagccgatgaaacggaatcattcattttgggctcagccacaaataaattatccagcgccgttggaagtttaccggaattgttggagaaaaagcggctattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcgcggcacaaaaacagttggaatgttctcaaaattgctcagccaaagttcaaaatttgtgatggaaggtgtgaagaatttggtgccaaaaaagcataatttaccactcacaaaggtttttaataatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcggcaaaatcaaccggcaatggatgtgattgcattcgtcattggcggtggaaattatgtggaataccaaaatgtgcaggaatgggcaaaatcgaagggattacagcgaatgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 436 - DNA, 2226 bp, Artificial Sequence
  Description of Artificial Sequence: Synthetic polynucleotide
  modified_base (1)..(438): a, c, t, g, unknown or other
  modified_base (622)..(702): a, c, t, g, unknown or other
  modified_base (769)..(771): a, c, t, g, unknown or other
  modified_base (893)..(895): a, c, t, g, unknown or other
  modified_base (897)..(897): a, c, t, g, unknown or other
  modified_base (900)..(904): a, c, t, g, unknown or other
  modified_base (906)..(906): a, c, t, g, unknown or other
  modified_base (1072)..(1074): a, c, t, g, unknown or other
  modified_base (1117)..(2226): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgccagccgagaacaatgtctgagcgcatgcctcaaggaaagggaattcgtgtgccgttccgtcaattacaattacgacacatatgcgtgcgaaatgagcaccgaggatcgcgttcaaagcccaaaatttgcgatgatggaccagccggtggactatttcgacaacaattgcctcaatcgtnnnnnnnnnnnnnnnnnnnnnnnnnnnnnnnnnnnnnnnnnnnnnnnnnnnnnnnnnnnnnnnnnnnnnnnnnnnnnnnnncagtccgttgagccgcaagagtcgaattgccttcagaaatgtttggactcgttgaacacattttgcnnntccgtcgaattctcgcccaacgagaagaattgcattgtcagcgacgaggacacattctcccgtgccgatcagcaagccgccgtccagtccaaggattactatgagccaatttgtgtttccgnnnanttnnnnncntcaacatgtcgtcaacaggcagcattcaatcgtttcattggtgtctccatcgagggccaaccggttgcatccgcccaaggcgtcacagtgtcggattgcatttcgctttgtttccaaaatttgaattgcaaatccatcaactacgatcgaacacagagcacctgcnnnatttatgcaattggacaggccaatgccaatgtgaaaaagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 437 - DNA, 1857 bp, Artificial Sequence
  Description of Artificial Sequence: Synthetic polynucleotide
  modified_base (106)..(174): a, c, t, g, unknown or other
  modified_base (357)..(357): a, c, t, g, unknown or other
  modified_base (598)..(600): a, c, t, g, unknown or other
  modified_base (684)..(684): a, c, t, g, unknown or other
  modified_base (763)..(1011): a, c, t, g, unknown or other
  modified_base (1155)..(1155): a, c, t, g, unknown or other
  modified_base (1423)..(1425): a, c, t, g, unknown or other
  modified_base (1773)..(1773): a, c, t, g, unknown or other
  modified_base (1786)..(1786): a, c, t, g, unknown or other
  modified_base (1818)..(1818): a, c, t, g, unknown or other
  modified_base (1840)..(1840): a, c, t, g, unknown or other
  modified_base (1852)..(1857): a, c, t, g, unknown or other
atgacatctaataacgacattgttgctcaacttcaagatgcggccaatcgaatgagagtttcttccattgagcaaacatgcaaagcaaattcgggtcatccaacgnnnnnnnnnnnnnnnnnnnnnnnnnnnnnnnnnnnnnnnnnnnnnnnnnnnnnnnnnnnnnnnnnnnnnccgcgacatccggctgccgatcgcttcattctatcaaagggtcatgcctgtcctatcctttatgctgcttgggaagaagctggtctgctcaccaatgaccaagtgctcagtttacgccgaattgactccgatattgaaggccatccgacaccaagactcaatttcattgatgtggccacagtntcacttggtcaaggactttcttgtgcagctggaatggcatatgctggaaaatatgtggacaaagcttcgtatcgtgtttattgccttatgggtgatggcgaaagtgcggaaggcagcgtttgggaagcagctgctttcgcaagttactataaactggacaatttggtggcaattgttgatgtgaatcgtcttggacaaagtcaacaaacaatgttgcaacatgaccttcaaacatataaannncgattcgaggcattcggtttcaattcaattgtggtggatggacacgatatcaacgctttagtaaaagcatatgctgatgcaganaataccaaaggaaaaccaacagcaatcgttgcaaagaccttcaagggcaaaggcattgacggcgttgaagaccaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgacatttccaattcgacattctcgaacaaagtattgaaaaaatatcccgaccaatttgtccaatgttttattgccgaacaaaacatggtcggcgttggtgttggtttggcttgtcgagggcgtgccattccccatattagnacctttgccgcattcttcactcgatctggcgatcaaattcgcatggctgccgtctcttttgcgaacgcaaaattcactggttcacatgtgggcgtttcaattggtgaggatgggccaagtcagatgggccttgaagatattgccttgttccgtgcactgcctgacagcattgttctttatccttcggatgctgttgccgccgaatatgccaccgaattggctgccaattacaatggaataacatatacacgagttagtcgtccaaccnnncctgtcatttatgctaacaatgagaagttcgagattggaaaatgcaaggttgttcgagaagctccacaggacaaatttatgctgattggcgccggtgtcacactttatgagtgcataaaggctcatgatgaactcaaagctgatggaattaatgtttgcgtggttgatttattctcggtaaaaccactcgatgtcgaaatgctaacaaaacatgcccaacgagttggtggtaaagttttgactgtggaagatcattatcaagctggtggactgggtgaagcggtggccatggcattggcagatattcccaatgttcgtgttcgccacatttgtgtcaaagacctcccncgttctggaccanccgatgcattgttggacttatatggcctcagntcaaagcatattgttgccgctntccagaattatnnnnnn

SEQ ID NO: 438 - DNA, 1377 bp, Artificial Sequence
  Description of Artificial Sequence: Synthetic polynucleotide
  modified_base (1)..(285): a, c, t, g, unknown or other
  modified_base (453)..(453): a, c, t, g, unknown or other
  modified_base (455)..(456): a, c, t, g, unknown or other
  modified_base (459)..(459): a, c, t, g, unknown or other
  modified_base (461)..(462): a, c, t, g, unknown or other
  modified_base (588)..(588): a, c, t, g, unknown or other
  modified_base (829)..(1377): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatgaatttatattaattaaatgcaataaaggaagtagcgcagcgaacaatttacaaatatggagtgggcgcttgtgggcctagaaatttctatggaacagtagacgttcatttggaattggaaaggaaattggctgaatttttgggctgcgaagaatcaattttntnnagntnnggatttgccacaatttcaagtgcaattccggcatattcaaaatctggggatataattttcgcggacaaagcagttaatttcgcaattcaaaaagggcttcaggcatcgaagagcaaaattgttggntttgaacacaatgatatggaacatttgaaaagtcttttgaaggaacaagatgaaatcgacaagaaaaatccaaggaaagcaaaaaatattcgacgatgcatcattgttgagggaattttcgcaaaaacggctgaaatttgcccattgccccaattgattgaattgaaatggaaatacaaagtgcgaatattcattgatgaatccctttcatttggagtacttggacaaaatggaaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 439 - DNA, 1623 bp, Artificial Sequence
  Description of Artificial Sequence: Synthetic polynucleotide
  modified_base (1)..(195): a, c, t, g, unknown or other
  modified_base (244)..(246): a, c, t, g, unknown or other
  modified_base (322)..(324): a, c, t, g, unknown or other
  modified_base (378)..(378): a, c, t, g, unknown or other
  modified_base (523)..(681): a, c, t, g, unknown or other
  modified_base (742)..(744): a, c, t, g, unknown or other
  modified_base (823)..(825): a, c, t, g, unknown or other
  modified_base (918)..(918): a, c, t, g, unknown or other
  modified_base (1102)..(1104): a, c, t, g, unknown or other
  modified_base (1273)..(1344): a, c, t, g, unknown or other
  modified_base (1621)..(1623): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtaacaatcaccaatgatggtgcgacaatactcaaccaaatgtctnnnatccatccgacagccaaaatgttagttgaactgtccaaggcacaggacatcgaagccggcgatggtacaaccacgnnngttgtattagccggctcattgttggatgcggctgagaaattattggccaaagcnattcatccgaccacaatttccgattcatttcgtcgcgcggccaccttttctcaacaaattcttgaagaaatggccactccaattgacatcaatgatgacgctgaattgattaagttggcaacgaccagtttgaattccaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaacagaattcgatgggtcatggaggaccgggccgtgttgagaaggcaaaaattggcnnnattcaattccaaatatcgccaccaaaaaccaatatggaaaatcaagtgattatttccgatacacacaaatggatcgagnnnctgaaggaagaacgcaattatattttggatttgtgcaaacaaataaagaaagccggatgcaatgttcttctcatccaaaaatctattctacgngatgccatcaacgatttggcactgcacttttttgctaaaatgaaaatcatggtcatcaaggatatcgaacgcgaggacattgaattctattcgaaaatactgggctgccgtccggtcgcttcccctgaccattttacagccgaaactttgggcaccgctgaattagtcgaagaaattgagaccnnngccgatggaaaagttgtcaaggtaaccggccttaaatcgagtggtcaagctgtttcgattctcatccgtggttcttccaaacttgttctcgaggaggctgaacgctctcttcatgatgctctttgtgtcattcgttgccttgtcaagaaacgcgctctacttccaggtnnnnnnnnnnnnnnnnnnnnnnnnnnnnnnnnnnnnnnnnnnnnnnnnnnnnnnnnnnnnnnnnnnnnnnnntattatttctaggcttttgctgacgcccttgaattgattccatacactttggccgagaatgctggactttcgcccattgagacggttacagaattgcgaactcaacacgccaatggacacaaggaattcggagtcaatgttcgaacgggcgccgtcaccaatattttggaggagaatgttcttcaaccgctgttggtctcctcttttgccatcaaacaagccgctgaatgcgttcgagccatcctcaaaattgatgacgtcgttttggctgtccgcnnn

SEQ ID NO: 440 - DNA, 1788 bp, Artificial Sequence
  Description of Artificial Sequence: Synthetic polynucleotide
  modified_base (1)..(84): a, c, t, g, unknown or other
  modified_base (457)..(528): a, c, t, g, unknown or other
  modified_base (733)..(960): a, c, t, g, unknown or other
  modified_base (1006)..(1008): a, c, t, g, unknown or other
  modified_base (1105)..(1107): a, c, t, g, unknown or other
  modified_base (1210)..(1323): a, c, t, g, unknown or other
  modified_base (1423)..(1425): a, c, t, g, unknown or other
  modified_base (1669)..(1671): a, c, t, g, unknown or other
  modified_base (1726)..(1788): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnncgtcaaccacaacaaggaaaagaagacaaagttggctcacaaatggcctattcatttgattcgacggcgctggagagggcagcacaggcagccaaaacacttgaaatgtcctcgaatgcaaaacaagcgctggaattgagcagattgcaggaaatgacaaagcaaaaggaatatgaactcaacaaaaggcaaattgaagcacggctggcctcaatgcaagccgagaatattcgagtggccgaggaagagcgccgaaagacattggtggaggaaacgaaacatgctagagcgagagccgaataccaagatcaattggcacgaaaacgacaagaggaagaaatgtcaatgaaggcccgattgcaggaagaatcannnnnnnnnnnnnnnnnnnnnnnnnnnnnnnnnnnnnnnnnnnnnnnnnnnnnnnnnnnnnnnnnnnnnnnncttcggcacaaattggacttggaacgaattgaggcagaggttcgggcaaagacgaaggcggccagggaaaatagagacgtgaatttggaaatgatgaaagcggaggaggaggagagacgaaaaacaatgactgagaggatcagaacaaccgggtcagtgcttggcgccggattgcaggatttcatcagcgacaagaccaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaatcccgcctccgggatgttgcaataacaacacgaaataccnnncgaaataatggcctcttccggaatgtgcttttctatggtccaccgggcactgggaaaacaatgtttgccaaaagtcttgcccgccattccggcttgnnntatgccatcatgacgggcggtgatgtggctccaatgggacgggatggcgtttcggcgatccacaaaatttttgattgggccgaaacctctaaaaaaggtctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtagatttatgttagctgtggcctccaatcaaccggaacaattcgattgggctgtaaatgatcgtctggacgaattgatcgaatttgatctactaggtnnnaaagaacgagaacgaattctgttgcaatacttcaaggaatacatcgccgatccggccacatccggggcgcgaaaacaacgcttaaaattgggcgacttcgattggatacccaaaatgcaggaaattgcaaaaatgacgcagggaatgtccggtcgagaactgtccaaattggtttttggatggcaggcaagtgcttatgcctcggatgatggcgtcttaacagtgcaaatgattgaccaaaacnnngccgaagtgttgaagcagcatcaacgcaaaatggaatggttgaatgcagaacggnnnnnnnnnnnnnnnnnnnnnnnnnnnnnnnnnnnnnnnnnnnnnnnnnnnnnnnnnnnnnnn

SEQ ID NO: 441 - DNA, 1491 bp, Artificial Sequence
  Description of Artificial Sequence: Synthetic polynucleotide
  modified_base (1)..(39): a, c, t, g, unknown or other
  modified_base (301)..(795): a, c, t, g, unknown or other
  modified_base (843)..(843): a, c, t, g, unknown or other
  modified_base (927)..(927): a, c, t, g, unknown or other
  modified_base (1081)..(1083): a, c, t, g, unknown or other
  modified_base (1194)..(1194): a, c, t, g, unknown or other
  modified_base (1386)..(1386): a, c, t, g, unknown or other
  modified_base (1489)..(1491): a, c, t, g, unknown or other
nnnnnnnnnnnnnnnnnnnnnnnnnnnnnnnnnnnnnnnccccaaaaaattttaactatcatcgacgggcgcggcactttccaaagcaatgaattggcagaagagctggacattgaccatcaaaaattggttggcgcaatcaaaagtttgcaggcgcaggatgggttaattgatgtgaaggagacgaaattgaaaagattggaattgaccggcgaaggggaacaaattatggtgaatggatcgcacgaattcaatgtttataagctgattggcgaacagggaatgcccaaaacggaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaacatccggcacgagattcgcatgacactttcttcctctcaagngccggcaattcaactgaatttccgagcgaatatttggaacgcgtccgaaaagttcattccgatggtggatttggctcaagacgntatcaatatgactggaaattggaggaagcccaaaagaatttgcttcgaacgcacacaaccgccgtttcggcccgtcaactttatttgcttgcacaaaatggtttcaaaccggccaaaatgttcagcattgatcgagttttccgcaatgaaactnnngatgccacacatttggccgaattccatcaagtcgagggggttgtggccgaaaggaatttgtcattggcccatgtgattggactgttcactgaattcttcaggaaatgcganatcaacaatcttcgcttcaagccaacctacaatccatatacggaaccgtcgatggaaatattcgcctatcatgatggactgaagaaatgggtggaaattggcaattcgggaatgttccggccggaaatgctcctcccgatgggtttgcccgaggatgttgcggttgccggttttggactttctttggagggnccaacaatgattcgatatgggctaacgaatattcgggaattattcggccacaaaatcaatctggaaatggtgtacaacaatccaatttgccagctggataaannn

SEQ ID NO: 442 - DNA, 4512 bp, Artificial Sequence
  Description of Artificial Sequence: Synthetic polynucleotide
  modified_base (1)..(3966): a, c, t, g, unknown or other
  modified_base (4006)..(4008): a, c, t, g, unknown or other
  modified_base (4171)..(4512): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaatggcacaatcatgaagtggtggtgatgatcggtnnnggcattggagtgacaccgtatgcatccactttgatggatttggtgctggaaagggcatccggaaatcatagtggataaaatgccgaaaaggtatatttcctttggatttgtccaacacataaaaattttgaatggtttgtggatgtcctaaaggaggtggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 443 - DNA, 1668 bp, Artificial Sequence
  Description of Artificial Sequence: Synthetic polynucleotide
  modified_base (1)..(339): a, c, t, g, unknown or other
  modified_base (448)..(1044): a, c, t, g, unknown or other
  modified_base (1074)..(1074): a, c, t, g, unknown or other
  modified_base (1076)..(1077): a, c, t, g, unknown or other
  modified_base (1080)..(1080): a, c, t, g, unknown or other
  modified_base (1083)..(1083): a, c, t, g, unknown or other
  modified_base (1085)..(1086): a, c, t, g, unknown or other
  modified_base (1089)..(1090): a, c, t, g, unknown or other
  modified_base (1092)..(1093): a, c, t, g, unknown or other
  modified_base (1100)..(1102): a, c, t, g, unknown or other
  modified_base (1105)..(1105): a, c, t, g, unknown or other
  modified_base (1107)..(1107): a, c, t, g, unknown or other
  modified_base (1122)..(1122): a, c, t, g, unknown or other
  modified_base (1126)..(1126): a, c, t, g, unknown or other
  modified_base (1130)..(1130): a, c, t, g, unknown or other
  modified_base (1138)..(1138): a, c, t, g, unknown or other
  modified_base (1140)..(1141): a, c, t, g, unknown or other
  modified_base (1143)..(1148): a, c, t, g, unknown or other
  modified_base (1152)..(1152): a, c, t, g, unknown or other
  modified_base (1155)..(1155): a, c, t, g, unknown or other
  modified_base (1161)..(1161): a, c, t, g, unknown or other
  modified_base (1165)..(1165): a, c, t, g, unknown or other
  modified_base (1167)..(1168): a, c, t, g, unknown or other
  modified_base (1170)..(1170): a, c, t, g, unknown or other
  modified_base (1210)..(1668): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataccaattttcatttttcagcgcaaattgaggtcatcccttgcaaagtttgtggtgacaaatcctccggtgtccattatggagtgatcacctgcgaaggatgcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcggttgaatggttggctaaaatttgcnannganctnannganntnntcaaatnnntcntngaatttgccaaggcnttgnatgnattcaagnanntnnnnnnagangancaaatnaatncnntnaagggatcctgcttccaaatgtccataattgccatggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 444 - DNA, 555 bp, Artificial Sequence
  Description of Artificial Sequence: Synthetic polynucleotide
  modified_base (1)..(60): a, c, t, g, unknown or other
  modified_base (295)..(357): a, c, t, g, unknown or other
  modified_base (502)..(555): a, c, t, g, unknown or other
nnnnnnnnnnnnnnnnnnnnnnnnnnnnnnnnnnnnnnnnnnnnnnnnnnnnnnnnnnnnatccaattaatccagggacaattcatcgaagaatatgatccaaccattgaggacagctataggaaacaggtgctcatcgacggcgaaacttgcctactggacattttggacacagctggccaagaggaatattcggcaatgcgggatcaatatatgcggaccggagaaggcttcttgctcgtttttgccctcaatgagtacaaatcattcgaaaacatccacgcctatcgcgaannnnnnnnnnnnnnnnnnnnnnnnnnnnnnnnnnnnnnnnnnnnnnnnnnnnnnnnnnnnnnnttgcagcaacgttccattgagcaacggtccatccaggaattggcccgttcctttggcattccattcatcgagaccagtgctaaaacccggaagcacgtggatgaagcattccatgctcttgttcgtgaaatcaggaagcataagnnnnnnnnnnnnnnnnnnnnnnnnnnnnnnnnnnnnnnnnnnnnnnnnnnnnnn

SEQ ID NO: 445 - DNA, 1392 bp, Artificial Sequence
  Description of Artificial Sequence: Synthetic polynucleotide
  modified_base (1)..(111): a, c, t, g, unknown or other
  modified_base (255)..(255): a, c, t, g, unknown or other
  modified_base (412)..(693): a, c, t, g, unknown or other
  modified_base (807)..(807): a, c, t, g, unknown or other
  modified_base (939)..(939): a, c, t, g, unknown or other
  modified_base (1099)..(1392): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccttcacttattcattgagtaagaatttaatattcagttatatataatgaaaatacaattttaggaggcgatattgtggaagtggagggtccagcatttgccgaatcaatttctgaaggagatattagatggcagaaaaangtcggagattttgtcaaatcggatgaaattgttgcggaaattgagaccgacaaaacctcggtcgaagttccagctccattttctgggaaaattgtggaatttttggttgaagatggttcaaaagttacagcaaagcagaaattatataaaatggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaccgaaacccgggtgaaaatgaatcgaatgagactgcgaattgcggagcggctgaaagaggcacaaaatacgaatgcaatgttgaccacattcaatgaaattgatcttttnaatgtgatgcaaatgcgaaagaaatatcaggaagcgttcacgaagaaacacggcgtcaaacttggcctaatgtccccatttgttcgggcatcggccattgctctgaaggaattgcctgttgtcaatgcaganattgagggcagcgaaataatttatcgaaactatgtggacatatcaattgcggttgccacccaaaaaggattggttgtgccggttttgcgaaatgtggagcagatgagctattcggaaattgagaaaatgttaggcgaacttggaatcaaggttagtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 446 - DNA, 1968 bp, Artificial Sequence
  Description of Artificial Sequence: Synthetic polynucleotide
  modified_base (1)..(426): a, c, t, g, unknown or other
  modified_base (582)..(582): a, c, t, g, unknown or other
  modified_base (672)..(672): a, c, t, g, unknown or other
  modified_base (1020)..(1020): a, c, t, g, unknown or other
  modified_base (1120)..(1968): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtttgtgccagtcatcaaattgcattataatggcatcgaattggacattctttttgcacgcttagcactcaaggaggtgtccgacagtcaacaactttccgatgacaatttgcttcgaaatttggacgagaagagtatccgatctctcaatgtntgccgagtagcggatgaaatccttcgacttatcccgaatcacagaaatttcattttaactttgagagcggtcaaactttgggcaaaaacncatggcatttattcaaatgtgctcggatttctcggcggtgtctcctgggccatcctcgtcgctcgaacctgtcagctctatccaaatgcagcacccgcaattttgctggagaaattcttcctcgtcttttcccaatgggaatggccttttccggtggttttgaaggatgcggatacatcacgaacggatatgccatattttgccgacatgatttgggacccacgaagccgaatttccgatcgataccatctgatgccaatcatcacacctgcgttcccggaacaaaattccacattcaatgtcacaaaatctacacggcaagtgatgatcaatgagttcaaagaagtnttgaatacaatgattgaaataaccaaaggcgaagctggctgggacaaactcttcgaagagatcaattttttcacccgttacaaacattttattgcacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 447 - DNA, 387 bp, Artificial Sequence
  Description of Artificial Sequence: Synthetic polynucleotide
  modified_base (1)..(27): a, c, t, g, unknown or other
  modified_base (166)..(387): a, c, t, g, unknown or other
nnnnnnnnnnnnnnnnnnnnnnnnnnnggcctacccattggctgatattcaactttctcaaaaattcttgatttgatccaacaatcactcaactaccatcaactgaagaaaggggcgaatgaagcgaccaagacgctgaaccgtggcatttctgaggtttccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 448 - DNA, 2490 bp, Artificial Sequence
  Description of Artificial Sequence: Synthetic polynucleotide
  modified_base (1)..(42): a, c, t, g, unknown or other
  modified_base (210)..(210): a, c, t, g, unknown or other
  modified_base (391)..(519): a, c, t, g, unknown or other
  modified_base (796)..(1314): a, c, t, g, unknown or other
  modified_base (1459)..(1467): a, c, t, g, unknown or other
  modified_base (1534)..(2490): a, c, t, g, unknown or other
nnnnnnnnnnnnnnnnnnnnnnnnnnnnnnnnnnnnnnnnnntataaaataatatttgtcagaacattgggtgcttcaatgcgtttgcgagatttgatacgacaagtgagggcggcgaggacggcagccgaggaacgagcagttgttgaaagggaaagtgccaatattcgtgactcatttcgggatgaagataacaaatacaaatgcagnaatatggccaaactcctctacatccatatgttgggttatcaagcgcattatggccaagtggaatgcgtaaaattggtgggcgagaaacgcttcaccgatattcgaattggctatttgggtgcaatgctattattggatgaacgatcggaaattcatttgctggtcacaaattgtttgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatttattttaaggcagctctttgtgctttccgaatcgtccgtaaagtgccagacttgattgaaatgttcatctccagcacgagatcattgctcaatgaaaagcaccatggcgttttgatggcgggcgtcacattggtttctgaaatgtgcgaactcagtgtcgatgttcggacacatttcaagaagatggtcccaaatcttgtgcgaatattgaaaaatctgcttatgaccggctattccccagagcatgatgtttcaggaattagcgatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcatttggacacaatggtcaatgttctccaattggccggcaaccatgttccggacgaagtggtcagcgccatgattcagctcatctcctcccaacccgatctccaaacctatgccagtgtccaactattccatgctgcccgcnnnnnnnnngtcaatgcccagcctcttctccaagtgtccttttggtgcattggggaattcggcgatttgctaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 449 - DNA, 4608 bp, Artificial Sequence
  Description of Artificial Sequence: Synthetic polynucleotide
  modified_base (1)..(258): a, c, t, g, unknown or other
  modified_base (340)..(342): a, c, t, g, unknown or other
  modified_base (381)..(381): a, c, t, g, unknown or other
  modified_base (496)..(496): a, c, t, g, unknown or other
  modified_base (504)..(504): a, c, t, g, unknown or other
  modified_base (519)..(519): a, c, t, g, unknown or other
  modified_base (531)..(531): a, c, t, g, unknown or other
  modified_base (534)..(534): a, c, t, g, unknown or other
  modified_base (543)..(544): a, c, t, g, unknown or other
  modified_base (546)..(546): a, c, t, g, unknown or other
  modified_base (600)..(600): a, c, t, g, unknown or other
  modified_base (606)..(606): a, c, t, g, unknown or other
  modified_base (609)..(609): a, c, t, g, unknown or other
  modified_base (615)..(615): a, c, t, g, unknown or other
  modified_base (627)..(627): a, c, t, g, unknown or other
  modified_base (771)..(771): a, c, t, g, unknown or other
  modified_base (882)..(882): a, c, t, g, unknown or other
  modified_base (905)..(905): a, c, t, g, unknown or other
  modified_base (921)..(921): a, c, t, g, unknown or other
  modified_base (942)..(942): a, c, t, g, unknown or other
  modified_base (955)..(955): a, c, t, g, unknown or other
  modified_base (972)..(972): a, c, t, g, unknown or other
  modified_base (991)..(991): a, c, t, g, unknown or other
  modified_base (993)..(993): a, c, t, g, unknown or other
  modified_base (1002)..(1002): a, c, t, g, unknown or other
  modified_base (1004)..(1004): a, c, t, g, unknown or other
  modified_base (1008)..(1008): a, c, t, g, unknown or other
  modified_base (1015)..(1015): a, c, t, g, unknown or other
  modified_base (1017)..(1017): a, c, t, g, unknown or other
  modified_base (1132)..(1218): a, c, t, g, unknown or other
  modified_base (1306)..(1422): a, c, t, g, unknown or other
  modified_base (1570)..(1602): a, c, t, g, unknown or other
  modified_base (1753)..(1753): a, c, t, g, unknown or other
  modified_base (1755)..(1755): a, c, t, g, unknown or other
  modified_base (1759)..(1759): a, c, t, g, unknown or other
  modified_base (1761)..(1765): a, c, t, g, unknown or other
  modified_base (1767)..(1768): a, c, t, g, unknown or other
  modified_base (1770)..(1770): a, c, t, g, unknown or other
  modified_base (1860)..(1860): a, c, t, g, unknown or other
  modified_base (1864)..(1864): a, c, t, g, unknown or other
  modified_base (1866)..(1867): a, c, t, g, unknown or other
  modified_base (1869)..(1869): a, c, t, g, unknown or other
  modified_base (1873)..(1874): a, c, t, g, unknown or other
  modified_base (1881)..(1881): a, c, t, g, unknown or other
  modified_base (1885)..(1886): a, c, t, g, unknown or other
  modified_base (1890)..(1894): a, c, t, g, unknown or other
  modified_base (1896)..(1896): a, c, t, g, unknown or other
  modified_base (1903)..(1903): a, c, t, g, unknown or other
  modified_base (1905)..(1905): a, c, t, g, unknown or other
  modified_base (1910)..(1911): a, c, t, g, unknown or other
  modified_base (1914)..(1914): a, c, t, g, unknown or other
  modified_base (1917)..(1918): a, c, t, g, unknown or other
  modified_base (1923)..(1923): a, c, t, g, unknown or other
  modified_base (1926)..(1926): a, c, t, g, unknown or other
  modified_base (1930)..(1930): a, c, t, g, unknown or other
  modified_base (1932)..(1932): a, c, t, g, unknown or other
  modified_base (1935)..(1935): a, c, t, g, unknown or other
  modified_base (1937)..(1938): a, c, t, g, unknown or other
  modified_base (1942)..(1945): a, c, t, g, unknown or other
  modified_base (1947)..(1947): a, c, t, g, unknown or other
  modified_base (1950)..(1950): a, c, t, g, unknown or other
  modified_base (1952)..(1952): a, c, t, g, unknown or other
  modified_base (1956)..(1956): a, c, t, g, unknown or other
  modified_base (1958)..(1958): a, c, t, g, unknown or other
  modified_base (1962)..(1965): a, c, t, g, unknown or other
  modified_base (1968)..(1968): a, c, t, g, unknown or other
  modified_base (1972)..(1972): a, c, t, g, unknown or other
  modified_base (1977)..(1977): a, c, t, g, unknown or other
  modified_base (1983)..(1983): a, c, t, g, unknown or other
  modified_base (1986)..(1987): a, c, t, g, unknown or other
  modified_base (1992)..(1993): a, c, t, g, unknown or other
  modified_base (1995)..(1995): a, c, t, g, unknown or other
  modified_base (2000)..(2001): a, c, t, g, unknown or other
  modified_base (2004)..(2004): a, c, t, g, unknown or other
  modified_base (2007)..(2008): a, c, t, g, unknown or other
  modified_base (2010)..(2010): a, c, t, g, unknown or other
  modified_base (2013)..(2015): a, c, t, g, unknown or other
  modified_base (2019)..(2021): a, c, t, g, unknown or other
  modified_base (2023)..(2023): a, c, t, g, unknown or other
  modified_base (2025)..(2025): a, c, t, g, unknown or other
  modified_base (2028)..(2028): a, c, t, g, unknown or other
  modified_base (2032)..(2036): a, c, t, g, unknown or other
  modified_base (2038)..(2039): a, c, t, g, unknown or other
  modified_base (2043)..(2044): a, c, t, g, unknown or other
  modified_base (2052)..(2052): a, c, t, g, unknown or other
  modified_base (2062)..(2062): a, c, t, g, unknown or other
  modified_base (2067)..(2068): a, c, t, g, unknown or other
  modified_base (2070)..(2074): a, c, t, g, unknown or other
  modified_base (2076)..(2078): a, c, t, g, unknown or other
  modified_base (2081)..(2082): a, c, t, g, unknown or other
  modified_base (2085)..(2085): a, c, t, g, unknown or other
  modified_base (2095)..(2095): a, c, t, g, unknown or other
  modified_base (2099)..(2100): a, c, t, g, unknown or other
  modified_base (2107)..(2111): a, c, t, g, unknown or other
  modified_base (2113)..(2113): a, c, t, g, unknown or other
  modified_base (2115)..(2116): a, c, t, g, unknown or other
  modified_base (2119)..(2124): a, c, t, g, unknown or other
  modified_base (2126)..(2126): a, c, t, g, unknown or other
  modified_base (2128)..(2131): a, c, t, g, unknown or other
  modified_base (2136)..(2136): a, c, t, g, unknown or other
  modified_base (2140)..(2140): a, c, t, g, unknown or other
  modified_base (2142)..(2143): a, c, t, g, unknown or other
  modified_base (2145)..(2145): a, c, t, g, unknown or other
  modified_base (2154)..(2155): a, c, t, g, unknown or other
  modified_base (2162)..(2162): a, c, t, g, unknown or other
  modified_base (2164)..(2164): a, c, t, g, unknown or other
  modified_base (2166)..(2166): a, c, t, g, unknown or other
  modified_base (2170)..(2170): a, c, t, g, unknown or other
  modified_base (2175)..(2175): a, c, t, g, unknown or other
  modified_base (2179)..(2179): a, c, t, g, unknown or other
  modified_base (2181)..(2182): a, c, t, g, unknown or other
  modified_base (2184)..(2187): a, c, t, g, unknown or other
  modified_base (2190)..(2190): a, c, t, g, unknown or other
  modified_base (2193)..(2194): a, c, t, g, unknown or other
  modified_base (2196)..(2196): a, c, t, g, unknown or other
  modified_base (2202)..(2202): a, c, t, g, unknown or other
  modified_base (2204)..(2204): a, c, t, g, unknown or other
  modified_base (2206)..(2206): a, c, t, g, unknown or other
  modified_base (2212)..(2214): a, c, t, g, unknown or other
  modified_base (2217)..(2219): a, c, t, g, unknown or other
  modified_base (2221)..(2221): a, c, t, g, unknown or other
  modified_base (2223)..(2223): a, c, t, g, unknown or other
  modified_base (2226)..(2226): a, c, t, g, unknown or other
  modified_base (2232)..(2232): a, c, t, g, unknown or other
  modified_base (2235)..(2235): a, c, t, g, unknown or other
  modified_base (2239)..(2239): a, c, t, g, unknown or other
  modified_base (2244)..(2244): a, c, t, g, unknown or other
  modified_base (2250)..(2250): a, c, t, g, unknown or other
  modified_base (2254)..(2254): a, c, t, g, unknown or other
  modified_base (2256)..(2256): a, c, t, g, unknown or other
  modified_base (2262)..(2262): a, c, t, g, unknown or other
  modified_base (2271)..(2271): a, c, t, g, unknown or other
  modified_base (2277)..(2277): a, c, t, g, unknown or other
  modified_base (2304)..(2306): a, c, t, g, unknown or other
  modified_base (2312)..(2313): a, c, t, g, unknown or other
  modified_base (2316)..(2316): a, c, t, g, unknown or other
  modified_base (2321)..(2321): a, c, t, g, unknown or other
  modified_base (2324)..(2325): a, c, t, g, unknown or other
  modified_base (2328)..(2329): a, c, t, g, unknown or other
  modified_base (2331)..(2331): a, c, t, g, unknown or other
  modified_base (2335)..(2335): a, c, t, g, unknown or other
  modified_base (2338)..(2343): a, c, t, g, unknown or other
  modified_base (2345)..(2345): a, c, t, g, unknown or other
  modified_base (2347)..(2349): a, c, t, g, unknown or other
  modified_base (2353)..(2353): a, c, t, g, unknown or other
  modified_base (2355)..(2355): a, c, t, g, unknown or other
  modified_base (2358)..(2361): a, c, t, g, unknown or other
  modified_base (2363)..(2367): a, c, t, g, unknown or other
  modified_base (2369)..(2369): a, c, t, g, unknown or other
  modified_base (2371)..(2373): a, c, t, g, unknown or other
  modified_base (2376)..(2376): a, c, t, g, unknown or other
  modified_base (2379)..(2379): a, c, t, g, unknown or other
  modified_base (2382)..(2382): a, c, t, g, unknown or other
  modified_base (2386)..(2386): a, c, t, g, unknown or other
  modified_base (2388)..(2388): a, c, t, g, unknown or other
  modified_base (2391)..(2397): a, c, t, g, unknown or other
  modified_base (2404)..(2405): a, c, t, g, unknown or other
  modified_base (2410)..(2410): a, c, t, g, unknown or other
  modified_base (2412)..(2412): a, c, t, g, unknown or other
  modified_base (2420)..(2421): a, c, t, g, unknown or other
  modified_base (2427)..(2428): a, c, t, g, unknown or other
  modified_base (2434)..(2436): a, c, t, g, unknown or other
  modified_base (2438)..(2444): a, c, t, g, unknown or other
  modified_base (2451)..(2452): a, c, t, g, unknown or other
  modified_base (2461)..(2461): a, c, t, g, unknown or other
  modified_base (2466)..(2466): a, c, t, g, unknown or other
  modified_base (2469)..(2469): a, c, t, g, unknown or other
  modified_base (2476)..(2478): a, c, t, g, unknown or other
  modified_base (2481)..(2481): a, c, t, g, unknown or other
  modified_base (2487)..(2487): a, c, t, g, unknown or other
  modified_base (2490)..(2490): a, c, t, g, unknown or other
  modified_base (2493)..(2493): a, c, t, g, unknown or other
  modified_base (2496)..(2628): a, c, t, g, unknown or other
  modified_base (2715)..(2715): a, c, t, g, unknown or other
  modified_base (2721)..(2721): a, c, t, g, unknown or other
  modified_base (2751)..(2751): a, c, t, g, unknown or other
  modified_base (2775)..(2775): a, c, t, g, unknown or other
  modified_base (2806)..(2806): a, c, t, g, unknown or other
  modified_base (2817)..(2817): a, c, t, g, unknown or other
  modified_base (2832)..(2833): a, c, t, g, unknown or other
  modified_base (2835)..(2835): a, c, t, g, unknown or other
  modified_base (2839)..(2841): a, c, t, g, unknown or other
  modified_base (2856)..(2857): a, c, t, g, unknown or other
  modified_base (2863)..(2864): a, c, t, g, unknown or other
  modified_base (2869)..(2870): a, c, t, g, unknown or other
  modified_base (2877)..(2877): a, c, t, g, unknown or other
  modified_base (2894)..(2894): a, c, t, g, unknown or other
  modified_base (2906)..(2908): a, c, t, g, unknown or other
  modified_base (2910)..(2911): a, c, t, g, unknown or other
  modified_base (2915)..(2915): a, c, t, g, unknown or other
  modified_base (2919)..(2919): a, c, t, g, unknown or other
  modified_base (2950)..(2950): a, c, t, g, unknown or other
  modified_base (2968)..(2968): a, c, t, g, unknown or other
  modified_base (2976)..(2977): a, c, t, g, unknown or other
  modified_base (2994)..(2994): a, c, t, g, unknown or other
  modified_base (2997)..(2997): a, c, t, g, unknown or other
  modified_base (3000)..(3001): a, c, t, g, unknown or other
  modified_base (3003)..(3003): a, c, t, g, unknown or other
  modified_base (3005)..(3009): a, c, t, g, unknown or other
  modified_base (3014)..(3014): a, c, t, g, unknown or other
  modified_base (3018)..(3018): a, c, t, g, unknown or other
  modified_base (3020)..(3020): a, c, t, g, unknown or other
  modified_base (3022)..(3022): a, c, t, g, unknown or other
  modified_base (3027)..(3027): a, c, t, g, unknown or other
  modified_base (3038)..(3039): a, c, t, g, unknown or other
  modified_base (3041)..(3047): a, c, t, g, unknown or other
  modified_base (3052)..(3054): a, c, t, g, unknown or other
  modified_base (3070)..(3072): a, c, t, g, unknown or other
  modified_base (3217)..(4608): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccatccgccaatattcctcactgattttcacacttcatccaatgaaacattttggcaatcggaaacaatggaggaaggannnattcacaaattccaagtgaatttgacacttcaattgggnaaagcatttgatattacctatgttcgattgagattcgctgctccaaggccagaaagtttcgtcatttacaagagaaccagggccgatgaccaatggcaaccttggcaattttacngtggctcntgccgttccacattnggtttgccgganaangcgccaatnntnccagcaaatgaggcaatggcccaatgcacccgggaattctcggatatttccccnttgacnggnggcganattgccttttcnacgttggaaggccgtccatcggccgtgaattttgaggaaagtgaagttttgcagaaatgggtgactgccaccgaaattatgatttcccttgtccgattgaatacatatggagatgaaatttggggcgatcctcgtgttcttggnacttatttctatgccatcaccgattttgccgtcggcggacgatgcaaatgcaatgggcacgcaaataaatgcgttaaatcaacgggacagggagaattacaaaaattggtntgtgattgtcaacataacacagntggagttgattgccangaatgtgctccattttatgtngatcgcccttggngaccagccacatccatngaagccaatgaatgtttgncntgcaattgnantggnctttccnanagatgcttttttgatgcgaaactttttgaggaaactggccatggaggccactgtatcgattgtgctggaaatactcagggacctcattgtgaacaatgtcttcctcaccattggnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgtaaaccgggtgttggcggtcaattttgcgaccaatgtttacctggctactatgaatttagttcaactggatgcaaggattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcctctccgccgataatccatttggttgttttccttgtttttgttttggccattcttcggtttgctccacatccgatggtttttatgcgagaaatatttccaccgatttcctggccaacatcgaaggatggaaaggcgccaatnnnnnnnnnnnnnnnnnnnnnnnnnnnnnnnnnctagataaagcagcagcagtttcgcaaattgacgattatcccgtctatttctatgcacccggaaaattccttggagatcaacgacaaaccttcaatcaatttgttcagttcacgctccgtgttcagcaaaccaatcccggacctagcaaanangatntnnnnntnntnggggcaaatggacgaatcctttcccttccattgggcgcccaaggcaatccggcaccaaccacccaaattcaacattatcaattccgaatncatncnnanccannacttcantggnntccnnnnntncgtgaantngattnnatnggnntcctntcnaatntntcngnnattnnnntncgngncacntnttcnnnnggngatnttggntttctntcnnatttnncnattgnntcngcnngnctnnntccnnnananggnattnnnnnanncgcnnattgggtngaacaatgcnaatgnncnnnnncnnntgnnggncaattttgtnaatnntgctcannnnnanannaannnnnncnannnnttggnggancnntnacaaaatgnnttccatncnantgcnatggncatncnnannnntgnganncngaatcngntntttgtnnntgnnnananaanactgcnggngatncatgngaacgntgcncncgtggntattatggngatgcnttggccggcactccaaacgattgcaannnatgtgnntgncctgnagnnggnncntgcnttnnnnnngngnnnggcntnatnnnntnnnnngnannnccnganggntatncnggnnnnnnntgcgaannttgtncngaagaatnnttcggnnatccannngnnnnnnntccttgnnaaaaatgtnattgnaanggaaatnnnganccaaangcnatnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttacgcacccggcacacttcgcccaaatcaagattatgaattgttggagtgccggcaaaccgatggacaatgtgaatgccaaccnaatgtnattggtcagcgatgcgagcaatgttccccnggctttttcaatatttcctctggnaatggatgtcaaccatgcgaatgcgatcccntaggcagtganggtggaatatgcganntnatannnggccaatgtgaatgnnaaccgnntgttnntggtcancgatgcgagcaatgttnccctggcttttnnnanntttnctcnaatggatgccaaccatgcgaatgcgatcccntaggcagtttggatggtnaatgcganncaataacaggccaatgnttntgnnancnnnnngttgnaggncnangatgngatcaatgttnngnnnnnnnttatnnnttgcgcaatggatgcnnngcttgtgatgattgttattctctaattcaatctagaaaaaatgatataaatcgaacaatgagtggcctgagggaaaatttagaagaaattcatcagaatcctgttacggttaatgacagcgatttcgatgaaagagtggaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 450 - DNA, 1365 bp, Artificial Sequence
  Description of Artificial Sequence: Synthetic polynucleotide
  modified_base (1)..(258): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (355)..(355): a, c, t, g, unknown or other
  modified_base (417)..(417): a, c, t, g, unknown or other
  modified_base (529)..(735): a, c, t, g, unknown or other
  modified_base (819)..(819): a, c, t, g, unknown or other
  modified_base (849)..(849): a, c, t, g, unknown or other
  modified_base (851)..(851): a, c, t, g, unknown or other
  modified_base (855)..(855): a, c, t, g, unknown or other
  modified_base (881)..(881): a, c, t, g, unknown or other
  modified_base (894)..(894): a, c, t, g, unknown or other
  modified_base (915)..(915): a, c, t, g, unknown or other
  modified_base (936)..(936): a, c, t, g, unknown or other
  modified_base (1111)..(1365): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaagcttggtcttgaagccaaaaaagatgaaaactattctgaatggtattcacaggtaataacgaaagccgaaatgatagantantangacgtcncaggctgctatgtccttcgtccatgggcatattcaatttgggaagtcatacaaacatttttngatgccgaaataaagaaattgggtgtaaaaaactgctactttcctatgttcgtctcagcagctgccttggaacgtgaaaaaactcacgtggcaaattttgcaccggaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggtcattcggcatttgcaactaaagaggaggctatcgacgaagtttacacaattctggacttatatgcgcgaatatacacngatttaatggcaattcccgttgtgaagggnangaanacagaaaaggaaaagttcgctggcgncgattttactacnactgttgaggcatatgttccngttaatggacgtggaattcanggagcaacttctcatcacttgggccaaaatttctcaaaaatgttcaatatatcttttgagcatccggataagcctggacaacgtgaatttgcatggcaaaatagctggggcctttcaacaagaacaattggtgcattaattatggtccatggagatgataatggtttggttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 451 - DNA, 570 bp, Artificial Sequence
  Description of Artificial Sequence: Synthetic polynucleotide
  modified_base (154)..(156): a, c, t, g, unknown or other
  modified_base (367)..(570): a, c, t, g, unknown or other
atgcctcgtgttaaaaacgttttctccaaagtttatgacgtcccgcgtcgtccattcgagaaggaacgacttgatgcggaaatcaaattgattggtgaatttggcctgagaaataaacgagaagtgtggcgcgtcaaattgactttggcaaaannncgcaaggcggctcgtgaattgctcacattggaggacaaggacccgaaacgtctattcgagggcaatgcactgctgcgtcgtttggtccgcatcggagtgctcagtgaggacaaaatgaaactcgattatgtgctcggccttcgcgtcgaagacttcatggaacgccgtttgcaaactcaagtgttcaaacttggattggccaaatccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 452 - DNA, 1356 bp, Artificial Sequence
  Description of Artificial Sequence: Synthetic polynucleotide
  modified_base (1)..(1167): a, c, t, g, unknown or other
  modified_base (1354)..(1356): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgtttcggtttccgagtcaacgattgtgccccactgttcagcattggcacttggatgggcgttattgtggcattattactgattggggttttgtcatttggctttttgatgctaaattccgttcaaacaatggaccgattcgatgatcccaaacaaaagcagttgatcataaatgcaaaagaannn

SEQ ID NO: 453 - DNA, 474 bp, Artificial Sequence
  Description of Artificial Sequence: Synthetic polynucleotide
  modified_base (1)..(84): a, c, t, g, unknown or other
  modified_base (189)..(189): a, c, t, g, unknown or other
  modified_base (204)..(204): a, c, t, g, unknown or other
  modified_base (210)..(211): a, c, t, g, unknown or other
  modified_base (213)..(213): a, c, t, g, unknown or other
  modified_base (220)..(220): a, c, t, g, unknown or other
  modified_base (222)..(222): a, c, t, g, unknown or other
  modified_base (225)..(225): a, c, t, g, unknown or other
  modified_base (234)..(235): a, c, t, g, unknown or other
  modified_base (240)..(241): a, c, t, g, unknown or other
  modified_base (246)..(246): a, c, t, g, unknown or other
  modified_base (255)..(255): a, c, t, g, unknown or other
  modified_base (268)..(268): a, c, t, g, unknown or other
  modified_base (270)..(271): a, c, t, g, unknown or other
  modified_base (277)..(278): a, c, t, g, unknown or other
  modified_base (282)..(282): a, c, t, g, unknown or other
  modified_base (294)..(294): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (318)..(318): a, c, t, g, unknown or other
  modified_base (324)..(324): a, c, t, g, unknown or other
  modified_base (340)..(340): a, c, t, g, unknown or other
  modified_base (351)..(352): a, c, t, g, unknown or other
  modified_base (354)..(354): a, c, t, g, unknown or other
  modified_base (356)..(356): a, c, t, g, unknown or other
  modified_base (358)..(360): a, c, t, g, unknown or other
  modified_base (362)..(362): a, c, t, g, unknown or other
  modified_base (364)..(364): a, c, t, g, unknown or other
  modified_base (366)..(370): a, c, t, g, unknown or other
  modified_base (372)..(373): a, c, t, g, unknown or other
  modified_base (375)..(381): a, c, t, g, unknown or other
  modified_base (387)..(388): a, c, t, g, unknown or other
  modified_base (390)..(391): a, c, t, g, unknown or other
  modified_base (394)..(394): a, c, t, g, unknown or other
  modified_base (396)..(396): a, c, t, g, unknown or other
  modified_base (472)..(474): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnaagaaaataacgcgtgaattgattacaacaattttggcaagaaaaccgaaaatgtgtgcatttttggagtataaagaattgaaaattgtctacaaaagatatgcntctctttattttctntgcgcnntngaacaancnganaatgaattnntttgnntgganacaatccancgttatgtggaantnntggacnnatantttggcagtgtntgngaattgganatnattttcaantttganaaggcctattttattntggatgaattnntntngnnngngnannnnnannannnnnnnaaaaannannttntnaaggcaatcagtgcacaggatttactgcaagatgaggaaacaacacaaggattttttgaagataatggtctcggcnnn

SEQ ID NO: 454 - DNA, 624 bp, Artificial Sequence
  Description of Artificial Sequence: Synthetic polynucleotide
  modified_base (1)..(309): a, c, t, g, unknown or other
  modified_base (424)..(624): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttttggctgaacaaggcaggcttgacaaattgccatcaatcgccaccagttttgagacaattatgcgtgctcatcgcaatgaactccaagtggaggtggccagtgctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 455 - DNA, 1746 bp, Artificial Sequence
  Description of Artificial Sequence: Synthetic polynucleotide
  modified_base (1)..(1176): a, c, t, g, unknown or other
  modified_base (1357)..(1536): a, c, t, g, unknown or other
  modified_base (1678)..(1680): a, c, t, g, unknown or other
  modified_base (1735)..(1746): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtcattttcgacaagaaaagtgagagcggcaaagtggccacaataattgttcgaggctcttcccaatccttgttggacgatgttgaacgtgcaattgacgatgctgtcaacacatacaaagcattgacaaaggataatcggcttttggctggcgctggtgccgtcgaaattgaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgatgtgctcaacggcaaattcattgatgccaaagagaccggcattttcgacttgttgagcggaaaattgctggcgctgaaattggccacaaatgcggcatgctccattctcaaaatcgaccagattataatggccaaannncccgttggcggaccaactccccgcggcccaaaggctcaggacgaggacgatgatnnnnnnnnnnnn

SEQ ID NO: 456 - DNA, 1770 bp, Artificial Sequence
  Description of Artificial Sequence: Synthetic polynucleotide
  modified_base (1)..(507): a, c, t, g, unknown or other
  modified_base (694)..(975): a, c, t, g, unknown or other
  modified_base (1138)..(1386): a, c, t, g, unknown or other
  modified_base (1549)..(1596): a, c, t, g, unknown or other
  modified_base (1606)..(1606): a, c, t, g, unknown or other
  modified_base (1614)..(1619): a, c, t, g, unknown or other
  modified_base (1626)..(1626): a, c, t, g, unknown or other
  modified_base (1629)..(1629): a, c, t, g, unknown or other
  modified_base (1632)..(1632): a, c, t, g, unknown or other
  modified_base (1636)..(1637): a, c, t, g, unknown or other
  modified_base (1641)..(1641): a, c, t, g, unknown or other
  modified_base (1644)..(1644): a, c, t, g, unknown or other
  modified_base (1647)..(1649): a, c, t, g, unknown or other
  modified_base (1651)..(1651): a, c, t, g, unknown or other
  modified_base (1653)..(1654): a, c, t, g, unknown or other
  modified_base (1656)..(1657): a, c, t, g, unknown or other
  modified_base (1659)..(1662): a, c, t, g, unknown or other
  modified_base (1671)..(1671): a, c, t, g, unknown or other
  modified_base (1673)..(1674): a, c, t, g, unknown or other
  modified_base (1676)..(1677): a, c, t, g, unknown or other
  modified_base (1680)..(1683): a, c, t, g, unknown or other
  modified_base (1687)..(1688): a, c, t, g, unknown or other
  modified_base (1696)..(1698): a, c, t, g, unknown or other
  modified_base (1701)..(1701): a, c, t, g, unknown or other
  modified_base (1768)..(1770): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgaagatattcaacgccgtcgagagggtgaccgtgagcatattgtccaattttcgaaccaaattgcggatgcgcaaagtgaattggaaatgttacgggcacgttggaaacaattgactgacgaggagaaacgtctgattggggacaatgcccgtctttgggatgagttgacaaaggcccgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacaatgatggaatcgaattaccaacgagaagaggtgaaaagaatgcgcgataatattggcgatttacggggaaaattgggcgaccttgagaaccggaatgcccaattggagaaggaagtacagaatttgaactaccagctaaatgatgaccaacgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtccaaaccaaaaccacattccaacgatctgcaaaggggaatatcacggtcgctgaatgcgagcccaatggaaaatacatcacattggagaatacgcacagaagcaaggatgaggacatttcgggatgtaggcttaagcgaaaactggatggaaaacgtnnnnnnnnnnnnnnnnnnnnnnnnnnnnnnnnnnnnnnnnnnnnnnnntcattgtagntttgggcnnnnnnccaaggnggnatncatnntccnccngannnantnntnntnnnnggcgaggananntnnggnnnnggcnnaaatgtgnnnacngctttctacaacaaagaaggcgaggaacgggcatcgcacacgcaaaagactgtccaaaccggacaannn

SEQ ID NO: 457 - DNA, 2907 bp, Artificial Sequence
  Description of Artificial Sequence: Synthetic polynucleotide
  modified_base (1)..(348): a, c, t, g, unknown or other
  modified_base (459)..(459): a, c, t, g, unknown or other
  modified_base (672)..(672): a, c, t, g, unknown or other
  modified_base (808)..(808): a, c, t, g, unknown or other
  modified_base (810)..(812): a, c, t, g, unknown or other
  modified_base (814)..(814): a, c, t, g, unknown or other
  modified_base (816)..(816): a, c, t, g, unknown or other
  modified_base (822)..(822): a, c, t, g, unknown or other
  modified_base (825)..(825): a, c, t, g, unknown or other
  modified_base (870)..(870): a, c, t, g, unknown or other
  modified_base (873)..(873): a, c, t, g, unknown or other
  modified_base (876)..(876): a, c, t, g, unknown or other
  modified_base (904)..(904): a, c, t, g, unknown or other
  modified_base (918)..(919): a, c, t, g, unknown or other
  modified_base (921)..(921): a, c, t, g, unknown or other
  modified_base (931)..(963): a, c, t, g, unknown or other
  modified_base (1080)..(1080): a, c, t, g, unknown or other
  modified_base (1086)..(1086): a, c, t, g, unknown or other
  modified_base (1092)..(1092): a, c, t, g, unknown or other
  modified_base (1174)..(1174): a, c, t, g, unknown or other
  modified_base (1198)..(1198): a, c, t, g, unknown or other
  modified_base (1204)..(1204): a, c, t, g, unknown or other
  modified_base (1206)..(1206): a, c, t, g, unknown or other
  modified_base (1218)..(1218): a, c, t, g, unknown or other
  modified_base (1471)..(2040): a, c, t, g, unknown or other
  modified_base (2181)..(2181): a, c, t, g, unknown or other
  modified_base (2500)..(2907): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcctgggaatttctaacaaaatggctccaaattccatcggatcgtctctatgtttcatattttggaggtgatgaatcttcaggtctaaagccagacgaagaatgcagncaaatttggctttcacttggcgtcagtgaacgcactattttgccatttggaatgaaggacaatttttgggaaatgggagacactggtccatgtggtccctgctcagaaattcattacgaccgcattggggacagagatgcttcgaatttggtgaatgccgacgatccgatggttgtggaaatttggaatcttgttttcattcaatataacagngaggaaggcgggcagctcagatcattgccaaataaacacattgactgtggtttgggctttgaacgattggtggccgttgttcaacaaaaaacatcaaattatgacaccgacctatttacgcctatttttcagaaantnnntnanggaacnggnattcgagaatacactggaaaaattggtgcagaggatgttgatggngtnganatggcctatcgagttgtggccgatcatntacggacattgacnntngcattgagcnnnnnnnnnnnnnnnnnnnnnnnnnnnnnnnnntatgtgctcagacgtattttacgtcgaggtgtccggtatgcaaccgaaaaattgaacgcaaaacccggatttttcgcctccttggtgccggttgtcattgatattttgggaaatacnttcacngaattncaaaaagaccctcaaacaataatggaaataatcaatgaagaagaaacacaatttttgaaaacattaaaaagaggccaaattntgtttgaaaaagctgtgaaaactntaccancnggagttcaaacncttcctggtcaaattgcatggcgcctttatgacacttatggattcccattggatttgacccaattaatggctgaagagaaaggattgaccattcaaatggaagaatacgaggaaagcaggaaaaaggccattgaaatttcatcatttggagctgccaaaatgaatgatgctttgaatttggatgttcacacattagcagaattacaaaaattgggcattcaaagcacagatgattcaccaaaatatatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggattacgtgccgtttttgatgaggcatatccggatccagttcgtgttgtggcaattggagtgcccatcgaaaagttgttagaagaaccaaaaagtgatttaggccaaaatacatcggttgaattctgggaggaacgncatttgcgaaatgcttcgcacattggacatttggtgatcacagcggaggaagcaattgccaaaggaattcgacgaattgttgccgtgaccggaccagaggcggaaaaagcattgcattcggccgatattttggacaaaaagattgaaaaattaactgaagaagccaaaaaagggctggaattggcaatgaatgaagagacggtgaaattattgggcaaatcattcatcgaatttgaagaggaattaaattgtcaattattgccatattggcgtcgagatgctctccgagaaaaggtcaaacaattgagaatgagtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 458 - DNA, 1443 bp, Artificial Sequence
  Description of Artificial Sequence: Synthetic polynucleotide
  modified_base (1)..(156): a, c, t, g, unknown or other
  modified_base (508)..(621): a, c, t, g, unknown or other
  modified_base (919)..(1443): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagataaagccaagcagttatggacagaaacgaaattattcaagtattgatatatcagcggagaaatggttgatggcatatgatgccgcatcaatggctaaacttgaaaatcctccttctttagccgatggaataagccaagaattggaaaaggaaattcgctatttgggttgtgaattaatacaatcgggcgcaattttacttaaattgaatcaaactgctgcagcaaccggccaaattatatttcaaagattttattatcagaaatcatttgtgcgttacaattttcagcatacgcttatggcttgtcttttgctggctagcaaaatcgaagaagaaccccgaaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattatgtgcgcacgaaaaatgaggtcatcaaggcagaacgacgaattctcaacacattgggcttcgttgttcacgtccatcatccgcacaaattgatttacatttatttattcatccttggtttgttgcgcaaaaaggacgatccaaatgccagtgctgaaagttatatgaatgatggattgaggacggatatgtttttgagatatccaccggagacaattgcatgcgcctgcattcaattggcggtcaaaactgtggaccaaccaattgtgcttccaaaagatccattcccatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 459 - DNA, 1059 bp, Artificial Sequence
  Description of Artificial Sequence: Synthetic polynucleotide
  modified_base (1)..(342): a, c, t, g, unknown or other
  modified_base (378)..(378): a, c, t, g, unknown or other
  modified_base (475)..(774): a, c, t, g, unknown or other
  modified_base (991)..(1059): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaccgtggttgtggaaccgcatcgtctcaaagtngtcttcatcgtcaaagggaaggaggatgcactggtcaccaaaaatctcgtgcctggcgaaactgtttatggcgaaaaacgcgtctctgtcccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcattgttgacacaattttctcggatgttgcccaaccggatcaggcacgaattgttgcccacaatgcgcacaaattccttaagaacaacggacatgtggtcatttcgatcaaagcaaattgcgtggacagcaccgctgaaccggaagccgtattcgctggtgaagtgaacaaattgcgcgaggaacagttcaaaccgattgagcaggttattattnnnnnnnnnnnnnnnnnnnnnnnnnnnnnnnnnnnnnnnnnnnnnnnnnnnnnnnnnnnnnnnnnnnnn

SEQ ID NO: 460 - DNA, 1332 bp, Artificial Sequence
  Description of Artificial Sequence: Synthetic polynucleotide
  modified_base (1)..(54): a, c, t, g, unknown or other
  modified_base (111)..(111): a, c, t, g, unknown or other
  modified_base (288)..(288): a, c, t, g, unknown or other
  modified_base (316)..(438): a, c, t, g, unknown or other
  modified_base (652)..(652): a, c, t, g, unknown or other
  modified_base (681)..(681): a, c, t, g, unknown or other
  modified_base (687)..(687): a, c, t, g, unknown or other
  modified_base (690)..(690): a, c, t, g, unknown or other
  modified_base (705)..(705): a, c, t, g, unknown or other
  modified_base (726)..(726): a, c, t, g, unknown or other
  modified_base (729)..(729): a, c, t, g, unknown or other
  modified_base (732)..(732): a, c, t, g, unknown or other
  modified_base (744)..(744): a, c, t, g, unknown or other
  modified_base (777)..(778): a, c, t, g, unknown or other
  modified_base (780)..(780): a, c, t, g, unknown or other
  modified_base (784)..(784): a, c, t, g, unknown or other
  modified_base (786)..(787): a, c, t, g, unknown or other
  modified_base (789)..(790): a, c, t, g, unknown or other
  modified_base (949)..(951): a, c, t, g, unknown or other
  modified_base (1024)..(1140): a, c, t, g, unknown or other
  modified_base (1234)..(1332): a, c, t, g, unknown or other
nnnnnnnnnnnnnnnnnnnnnnnnnnnnnnnnnnnnnnnnnnnnnnnnnnnnnngatgttgaaatgtggaagataaagcgactaatcaaatcgctggaagcagctcgccgnaatggaacctcaatgatttcgctgatcattccacccaaggatcaaattccgcgggtcacaaaaatgttgtccgacgaattcggcactgcatcgaacatcaaatcgcgggtgaacagacaatccgtgctggccgcaatcacttccgtacaacaacggctgaaattgtacaacagatancccgaaaatggattggtggtctattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctaattgatgacaacaaatttggcttcatcattatggacggcaatggatgcctgtacggaacgctccagggcaacaccaaagacattttgcacaaattcacggtggaattgcccaaaaagcatggacgcggtggacagtcggcacttcgattcgctcggctaaggatggagaaacggcacaattacataaggaaagtggcggaaatggccntggaaatgttcatcaaaaatgataaagtnatggtnacngggttggtgctggcnggcagtgcccaattcaaaacnganctnggccaatccganatgttcgatcagagattgcaggtttcaattttnnanattntnnanntatcctacggaggcgaaagtggattcaacgaggcaatcgagttggccgccgacgcactgaccgatgtgaaattcatcaaggaaaagaaactgattggctcatttttcgacgaaatttcgcgcgacaccaacaaagccatctacggtgtccaggagactnnnactgcgctggagatgggcgcaattgaaataatcatttgctgggagaatttggcattatgaggtttgaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctggaatggttggcggacaattacaaaaaatttggtgcagtgctggaaattgtgagcgacaaatcgcaagagggcgcccaatttgtacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 461 - DNA, 2022 bp, Artificial Sequence
  Description of Artificial Sequence: Synthetic polynucleotide
  modified_base (1)..(567): a, c, t, g, unknown or other
  modified_base (587)..(592): a, c, t, g, unknown or other
  modified_base (594)..(594): a, c, t, g, unknown or other
  modified_base (599)..(600): a, c, t, g, unknown or other
  modified_base (602)..(603): a, c, t, g, unknown or other
  modified_base (605)..(605): a, c, t, g, unknown or other
  modified_base (609)..(609): a, c, t, g, unknown or other
  modified_base (613)..(613): a, c, t, g, unknown or other
  modified_base (615)..(615): a, c, t, g, unknown or other
  modified_base (618)..(618): a, c, t, g, unknown or other
  modified_base (622)..(624): a, c, t, g, unknown or other
  modified_base (627)..(629): a, c, t, g, unknown or other
  modified_base (631)..(635): a, c, t, g, unknown or other
  modified_base (638)..(639): a, c, t, g, unknown or other
  modified_base (642)..(642): a, c, t, g, unknown or other
  modified_base (645)..(649): a, c, t, g, unknown or other
  modified_base (651)..(654): a, c, t, g, unknown or other
  modified_base (659)..(659): a, c, t, g, unknown or other
  modified_base (663)..(663): a, c, t, g, unknown or other
  modified_base (675)..(675): a, c, t, g, unknown or other
  modified_base (681)..(683): a, c, t, g, unknown or other
  modified_base (690)..(692): a, c, t, g, unknown or other
  modified_base (696)..(696): a, c, t, g, unknown or other
  modified_base (714)..(714): a, c, t, g, unknown or other
  modified_base (717)..(717): a, c, t, g, unknown or other
  modified_base (720)..(723): a, c, t, g, unknown or other
  modified_base (728)..(728): a, c, t, g, unknown or other
  modified_base (733)..(735): a, c, t, g, unknown or other
  modified_base (738)..(739): a, c, t, g, unknown or other
  modified_base (741)..(741): a, c, t, g, unknown or other
  modified_base (750)..(753): a, c, t, g, unknown or other
  modified_base (802)..(1092): a, c, t, g, unknown or other
  modified_base (1290)..(1290): a, c, t, g, unknown or other
  modified_base (1408)..(1409): a, c, t, g, unknown or other
  modified_base (1413)..(1414): a, c, t, g, unknown or other
  modified_base (1416)..(1416): a, c, t, g, unknown or other
  modified_base (1422)..(1422): a, c, t, g, unknown or other
  modified_base (1432)..(1435): a, c, t, g, unknown or other
  modified_base (1437)..(1438): a, c, t, g, unknown or other
  modified_base (1440)..(1442): a, c, t, g, unknown or other
  modified_base (1446)..(1453): a, c, t, g, unknown or other
  modified_base (1455)..(1462): a, c, t, g, unknown or other
  modified_base (1464)..(1465): a, c, t, g, unknown or other
  modified_base (1468)..(1470): a, c, t, g, unknown or other
  modified_base (1472)..(1472): a, c, t, g, unknown or other
  modified_base (1474)..(1474): a, c, t, g, unknown or other
  modified_base (1476)..(1476): a, c, t, g, unknown or other
  modified_base (1479)..(1481): a, c, t, g, unknown or other
  modified_base (1483)..(1484): a, c, t, g, unknown or other
  modified_base (1486)..(1491): a, c, t, g, unknown or other
  modified_base (1493)..(1493): a, c, t, g, unknown or other
  modified_base (1498)..(1505): a, c, t, g, unknown or other
  modified_base (1507)..(1507): a, c, t, g, unknown or other
  modified_base (1509)..(1509): a, c, t, g, unknown or other
  modified_base (1514)..(1518): a, c, t, g, unknown or other
  modified_base (1520)..(1520): a, c, t, g, unknown or other
  modified_base (1522)..(1522): a, c, t, g, unknown or other
  modified_base (1524)..(1524): a, c, t, g, unknown or other
  modified_base (1527)..(1528): a, c, t, g, unknown or other
  modified_base (1531)..(1531): a, c, t, g, unknown or other
  modified_base (1533)..(1536): a, c, t, g, unknown or other
  modified_base (1539)..(1540): a, c, t, g, unknown or other
  modified_base (1545)..(1546): a, c, t, g, unknown or other
  modified_base (1554)..(1554): a, c, t, g, unknown or other
  modified_base (1557)..(1557): a, c, t, g, unknown or other
  modified_base (1560)..(1560): a, c, t, g, unknown or other
  modified_base (1563)..(1567): a, c, t, g, unknown or other
  modified_base (1569)..(1569): a, c, t, g, unknown or other
  modified_base (1572)..(1574): a, c, t, g, unknown or other
  modified_base (1576)..(1579): a, c, t, g, unknown or other
  modified_base (1581)..(1582): a, c, t, g, unknown or other
  modified_base (1584)..(1586): a, c, t, g, unknown or other
  modified_base (1588)..(1588): a, c, t, g, unknown or other
  modified_base (1592)..(1593): a, c, t, g, unknown or other
  modified_base (1599)..(1599): a, c, t, g, unknown or other
  modified_base (1602)..(1604): a, c, t, g, unknown or other
  modified_base (1614)..(1614): a, c, t, g, unknown or other
  modified_base (1626)..(1626): a, c, t, g, unknown or other
  modified_base (1666)..(2022): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatcaataatgttcaacnnnnnntnactcnnanngntgtncgtnantanttgnnnaannnannnnnatnngantgnnnnntnnnnatttnccangcaaaagtggcncaaaannnttatggnnntganaaaaggtttttctgcccnccnccnnnngtctntttgnnnggnnanggatggcgnnnncggcgaaaaacattggatcaaatttttcggcaattgaaggaagaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatttcgaagccatcaaagaagaagaataataataaacaagcggacattaaaaatattaatattgcaagtggcacggaaattgcattgttcagccgggttcgctcgcaaacaacgaatacgcgttatttatttgttaaagatggaaaatttattgcacattcaaagttttggggctcatttacaattcacttaaangagggtgaacaacttgacccatatgttgacgattttcatgtaaccgatggatatataaactatggatcaattataaagctggtggacagtgtcagcggacttgctttgccaatgatgnnaatnngnaaagtngataaacaannnntnntnnnggannnnnnnngnnnnnnnnannaannnantnanttnnntnnannnnnntntcaannnnnnnncnangaaannnnntntntntgnnttncnnnngannaaatnnttcaacangangcnatnnnnntngannntnnnngnnannnantcanngatggngcnnnatggacgatnatttcaacgganacaattcattatcgattctatgaggcacttggacctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 462 - DNA, 1401 bp, Artificial Sequence
  Description of Artificial Sequence: Synthetic polynucleotide
  modified_base (1)..(36): a, c, t, g, unknown or other
  modified_base (142)..(162): a, c, t, g, unknown or other
  modified_base (421)..(600): a, c, t, g, unknown or other
  modified_base (780)..(780): a, c, t, g, unknown or other
  modified_base (985)..(987): a, c, t, g, unknown or other
  modified_base (1123)..(1320): a, c, t, g, unknown or other
  modified_base (1393)..(1401): a, c, t, g, unknown or other
nnnnnnnnnnnnnnnnnnnnnnnnnnnnnnnnnnnnaattttgcttatattttccaggatatctttggatgggttcgagaaggaaatgctttccaagttcgagtttggctggatgataccgaacatgacctgaatgtcgggnnnnnnnnnnnnnnnnnnnnnttacattgggccgctttgcatggatttagagcaattgcacgaaatttactccaacacaatgcaaatatgtttgtgtcaaatgccaatggcaatatgccaattcatatgacaatccaacatggccaaagggaaatagtcaaattattaattgaaaatggacaaaatgcaattgtggaaaatggatacggacaaacaccgctggaattggcaattttgaatggacgaaaggaaattgcagaggatttgttgaatgctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatacaccggtgtcgatttacaatcattggcattgaccaagccaattgcccaatcacattcaggcaccctttatcgtggaaaatggcaaggaaatgatattgtggcgagagtgctgaatattccgaatgtgaccgagcggatttcgcgagatttttccaccgaatttccctcattaagnatatttgcaagtgcccacacgaatccagtcttggccgccgtcaatcagccaccacaattgattgttattagccaatttatgccctttggttccctttacaatgttttgcacgaacaatcagcggtcgtcattgatcatacgcaggcaattcggtttgcattggacattgccaaaggaatgtcattccttcattcctggcagccannnattcttcgctatttcctaagctcaaaacacattgttattgacgaggatcttagtgccaaaatttcgctggccgatacaaaattttccttccaagagattgggcgtctctattctccgggttggatggcaccggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatttgcctaaatgaggacccgggccgaagaccaaatttcgatcaaattattccaattcttgagaagatgnnnnnnnnn

SEQ ID NO: 463 - DNA, 606 bp, Artificial Sequence
  Description of Artificial Sequence: Synthetic polynucleotide
  modified_base (1)..(432): a, c, t, g, unknown or other
  modified_base (604)..(606): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaggacgaagtggaagagaccaaagttgttttgcacaacacaatgcaatccgtgctggagaggggcgaaaaattggatgatttgatcaaggccagcgaaaatttgtccgaccaaagcaaaatgttttatacacaagcgaagaagatgaacaaatgttgcaattatgttnnn

SEQ ID NO: 464 - DNA, 1389 bp, Artificial Sequence
  Description of Artificial Sequence: Synthetic polynucleotide
  modified_base (1)..(222): a, c, t, g, unknown or other
  modified_base (438)..(438): a, c, t, g, unknown or other
  modified_base (508)..(903): a, c, t, g, unknown or other
  modified_base (1015)..(1389): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaattttaagttggatccaaacaaaattggttttttggccgttggaactgaaacattgatcgacaggagtaaaagtgtcaaatcagtgctggttgaattgttcgcagaatcaacagagatctcgagggaattgacgaaagaatgcctgctttgggggaacacaagcattgtgcatgccgccgattggatatacgcaaattatgaatttgaagcnaaacttgctattgttgtttgtgttgatgtggcaatctatgaacaaggaccagcaagatgcaccggtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcaatggaggccagtgcaaaagcagctgaacaaaaattgactcgacatttggaatttggacgccgaattggaaatatgtacacgcccagtctttatgctcagctgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 465 - DNA, 3027 bp, Artificial Sequence
  Description of Artificial Sequence: Synthetic polynucleotide
  modified_base (1)..(582): a, c, t, g, unknown or other
  modified_base (859)..(1128): a, c, t, g, unknown or other
  modified_base (1321)..(1321): a, c, t, g, unknown or other
  modified_base (1323)..(1323): a, c, t, g, unknown or other
  modified_base (1326)..(1326): a, c, t, g, unknown or other
  modified_base (1332)..(1333): a, c, t, g, unknown or other
  modified_base (1335)..(1336): a, c, t, g, unknown or other
  modified_base (1338)..(1338): a, c, t, g, unknown or other
  modified_base (1341)..(1341): a, c, t, g, unknown or other
  modified_base (1347)..(1347): a, c, t, g, unknown or other
  modified_base (1350)..(1353): a, c, t, g, unknown or other
  modified_base (1355)..(1356): a, c, t, g, unknown or other
  modified_base (1359)..(1359): a, c, t, g, unknown or other
  modified_base (1365)..(1365): a, c, t, g, unknown or other
  modified_base (1368)..(1368): a, c, t, g, unknown or other
  modified_base (1374)..(1374): a, c, t, g, unknown or other
  modified_base (1377)..(1381): a, c, t, g, unknown or other
  modified_base (1383)..(1383): a, c, t, g, unknown or other
  modified_base (1385)..(1387): a, c, t, g, unknown or other
  modified_base (1389)..(1396): a, c, t, g, unknown or other
  modified_base (1398)..(1398): a, c, t, g, unknown or other
  modified_base (1401)..(1406): a, c, t, g, unknown or other
  modified_base (1410)..(1410): a, c, t, g, unknown or other
  modified_base (1438)..(1863): a, c, t, g, unknown or other
  modified_base (1972)..(3027): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggacaaattacgctacgaaagtcgaaaaagctacttggccaagcgcaaagatgataaacgaatggaattggaggcggaagtgctcgacgacaaaacaatatttgctcgggagaagttgacgaggaaggagaaaatggacatggaatatcgggaaaaagtgctccaatttgtgcagcaatacgatgaggcggggaatgtgctcaaagtccccagatatcacgtgccagatgcagcacaaaaagaaattcccgacaattatgtggaagaaccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatacatttaaaatttccataatttaaggtgaaaccggctcaggcaaaagtacccaattaccacaatatttggccgaatttggttgggccgaaaatgggatgaaaatttgcgtgacgcagccaaggagggtggccgcaattacattggccagcagagtggccgatgaaatgatgtgcaaattgggtgatnangtnggctanncnntncgntttgangannnnanntcngagcgnacnaaaatnaannnnntnannnannnnnnnntnttnnnnnnattnttgaatgaacccgatttggcctcctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcatcgagtgttcgagccggtcgggccagatcaacgcaaaataattctctcaacgaacattgccgaaacatccgtcaccattgatgatgtggttttcgtcatcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 466 - DNA, 2037 bp, Artificial Sequence
  Description of Artificial Sequence: Synthetic polynucleotide
  modified_base (1)..(237): a, c, t, g, unknown or other
  modified_base (276)..(276): a, c, t, g, unknown or other
  modified_base (408)..(408): a, c, t, g, unknown or other
  modified_base (628)..(810): a, c, t, g, unknown or other
  modified_base (1231)..(2037): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgaccaaagttttgccatttatggcggtgttggaganctttatgactatggaccgatgggatgtgcattgaaacagaacatgatccaggtttggcgcaatcatttcattcttgaggaagcaatgttggaagttgaatgcacatcattgaccccggaaaatgttctaaangcgtcaggacatgttgaccgttttattgattggatggtcaaggacaaagttacgggtgcttgttttcgtgccgatcatttgattaaaaatcaagctgagacattgatcaaggataagaagaccgcaccagatttgaagaaagatttagaggatgttcttgttcgtttggatggattaagctgtgatgaaatggccgaaactattcgaaaattcaatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaattggcaccggctttcgcaatgaaatttcaccaagacaaggcctgatccgggtccgtgaattcacaatgtgcgaaattgaacattttgtggatcccacaaacaaaaaacatccaaaatttgctcgaattgctgacactgaattgatgctcttttcggcttgcaatcaatggatgggaaaggaatggagaaggatggcaattggtgaggccgtggccaaaaggaatgtcgacaatgaaacgctgggctactacatggctcgaacgcatctctttatgctggccgtgggcattgcaccagacaaacttcgttttcggcaacatttgtccaatgaaatggcccattatgcaaaggattgctgggatgcggaatgcctgaccacatacgggtggattgaatgcgttgggaatgcggaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 467 - DNA, 3561 bp, Artificial Sequence
  Description of Artificial Sequence: Synthetic polynucleotide
  modified_base (1)..(30): a, c, t, g, unknown or other
  modified_base (216)..(216): a, c, t, g, unknown or other
  modified_base (286)..(1398): a, c, t, g, unknown or other
  modified_base (1576)..(1896): a, c, t, g, unknown or other
  modified_base (2019)..(2019): a, c, t, g, unknown or other
  modified_base (2065)..(3561): a, c, t, g, unknown or other
nnnnnnnnnnnnnnnnnnnnnnnnnnnnnngttaatgagattaaaaagattgaagaacggatccaacaaaagtggtatgaagcaaaggcttttgaagaggatgcgcccgatgtgaaagaaatgaaatttatgactacatttccattcccttacatgaatggacgtctacatctgggtcatacattcacattatccaaatgtgaatttgcagcagantttcatcgactcctaggccaaaaatgtatttttccttttgcatttcattgtactggaatgccaatcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtctatttgaaaggattctatcaagggatcatgcttgtcggcaaatataaaggggagagaacagaaaatgttaaaaagcaaattcaagaagatttatcaagaaatggtgaggcatgcaaatatgttgagccagagaagaaagttctttcacgatccggcgatgattgtgtagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataatgtttgggattttatcttcttgggagccgactatgatgcagagaaaatgccaattgagaaggagaaattgcaaaaaatgcgacatgagtttgaattttggtatccggtggatatgggngtttctggaaaagacttgatccaaaatcacctaacttattatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 468 - DNA, 807 bp, Artificial Sequence
  Description of Artificial Sequence: Synthetic polynucleotide
  modified_base (1)..(279): a, c, t, g, unknown or other
  modified_base (442)..(510): a, c, t, g, unknown or other
  modified_base (628)..(807): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgctttcataaagggccatcatccggcccaattcaccaatttgatattcatttgtggcgtcgatgtgccaactcgcaaaaatcgcttcgaggtggtctatgcgcttctttcgcttcgctacaatgcacggattcgggttcgaacatacaccgatgaggttnnnnnnnnnnnnnnnnnnnnnnnnnnnnnnnnnnnnnnnnnnnnnnnnnnnnnnnnnnnnnnnnnnnnntacggtgtatggttcaacaatcatccagacttgcggcgcattcttacggactatggctttgaagggcatccacagaggaaagatttcccgctgactggctatcaagaggttacttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 469 - DNA, 2568 bp, Artificial Sequence
  Description of Artificial Sequence: Synthetic polynucleotide
  modified_base (1)..(69): a, c, t, g, unknown or other
  modified_base (346)..(396): a, c, t, g, unknown or other
  modified_base (772)..(801): a, c, t, g, unknown or other
  modified_base (1117)..(1206): a, c, t, g, unknown or other
  modified_base (1296)..(1296): a, c, t, g, unknown or other
  modified_base (1329)..(1329): a, c, t, g, unknown or other
  modified_base (1386)..(1386): a, c, t, g, unknown or other
  modified_base (1558)..(1566): a, c, t, g, unknown or other
  modified_base (1794)..(1794): a, c, t, g, unknown or other
  modified_base (2007)..(2007): a, c, t, g, unknown or other
  modified_base (2154)..(2154): a, c, t, g, unknown or other
  modified_base (2157)..(2157): a, c, t, g, unknown or other
  modified_base (2172)..(2172): a, c, t, g, unknown or other
  modified_base (2248)..(2568): a, c, t, g, unknown or other
nnnnnnnnnnnnnnnnnnnnnnnnnnnnnnnnnnnnnnnnnnnnnnnnnnnnnnnnnnnnnnnnnnnnntcagaggacattgcttatgaagaggacattattcgcaatcctggactactccgtccttgggaacgttacatcgaacacaaagttaaaacaaaagcggacccaaaacaagttcgactggtttttgagcgtgcactgaaacttttcaatagaagttacaaattgtggtacaattatttgaaatatagaagaagaacaattgcccataaaccgtctaccgatattgtttatgcccatctttcggatgcatatgaacgctgtttagtctttttgaacaaannnnnnnnnnnnnnnnnnnnnnnnnnnnnnnnnnnnnnnnnnnnnnnnnnnatcactgaaactcgccgagtttttgatcgagctcttcgggcattgccaataacgcaacatatgagaatttggccaatttacattgaattcgtcacaaaatataatattccggagacggccatccgaatttatcgaagatatttgaaggttaatccaagtggaagggaagattatgtggaatatttaaaacaaatcgacaaattggatgaagcggcacaacaaatggcaattttggtcaatgaagatagaccaataagtgaaaaaggcaaaactggccatcaaatttggacggaattatgcgacctcatctcaaaaaatccaaataaaatttattcactccaagttgagccaataatccggcaaggaatttcccgtnnnnnnnnnnnnnnnnnnnnnnnnnnnnnngccttggctgaatattacattcgaacaccaaattttgagaaggcccgcgatgtattcgaagaggcaatgggcgttgtcaaaacagttcgggattttacccaaattttcgatgcatatagcaaatttatggagcgaatgagttcattaaaaatgaaagaattggaagagtcacaaattgaggagaaagaattggagttggaattggtgatgacccgttttgagcatttaatggaaagaaggccattattattgaacagtgttttgttgagacaaaatccgcataatgttcatgaatggctgaatcgagttcaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtggatttcattcgcaaaattatatgaaaaatttggccaattggaaaatgcacgtgaaatattcgaaaaggcagttcaagtgaatttngcaaaagtcgatgaattggcccaagtttggtgngattatgccgaaatggaattacggcacaagtaaattaaattaacatttaaaattgancgggccaccactcctccaccaagaaggggcgattatgacgaaaatgcaaaagtgcaaagccgtgtttttcgttcactcaaactttggtcattgtatgcggacattgaggaatcgatgggctcattggacagttgccgtgaaatatacgaccgaatgatggaacttcgaattnnnnnnnnncaaattatcatcaattatgcactatttttggaggaaaatcattattttgaagaagcattcagggcatttgaaaagggaattggactttttcgatggccgctggtctacgacatttggaatgtttatttgaccaaattcattcatcgttatggtggaaagaagttggaaagggcccgggatttgttcgaacaatgtttggaaaaatgtccaccaaaatatgcaaaaatnatttatttgctttattcaaaattggaggaggaacacggattggccagacacgcaatggaaatttacaatcgggcgacggaggcagtggacaaagatgaaaaacatttgatttacaatgtttacatcaaaaaagcaatggaattttatgggatcacaaaaacaaggccaatattcgaatcggccattgaaagattgccggaggatcgttccggngaaatgagtatgcgatatgcccaagtggagaggaatttgggcgaaattgaccgggcaagggccatttatgcacattgcgccgaaatttgcgatccacgggttcaatcacaattttgggaaacttggaaagaatttgaagtgaagcanggnaatgaggacacaatncgggaaatgctgcgggtgaagagatcagtgcaggcaacgtacaacacaaatgtgaattatatgagcgcccaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 470 - DNA, 1542 bp, Artificial Sequence
  Description of Artificial Sequence: Synthetic polynucleotide
  modified_base (1)..(30): a, c, t, g, unknown or other
  modified_base (144)..(144): a, c, t, g, unknown or other
  modified_base (763)..(765): a, c, t, g, unknown or other
  modified_base (882)..(882): a, c, t, g, unknown or other
  modified_base (958)..(1041): a, c, t, g, unknown or other
  modified_base (1120)..(1332): a, c, t, g, unknown or other
  modified_base (1504)..(1542): a, c, t, g, unknown or other
nnnnnnnnnnnnnnnnnnnnnnnnnnnnnnggacaaattgcatgttgtgaatgcggcactccaatagctccaaatgcagcaaatatgtgtgtgggatgcatccggtcaagggttgatattaccgacggaataatgaaacaactncaacttcaatcatgtcgaaattgcagccgttattttattcctccgaattcgtgggtttatgccgaattggaatcaaaggaattgatgtcaatttgccttggacgtttgaaatcgacgatgcaaaaagtgcgacttatcgatgctgtgtttatttggaccgaaccgcattcaaggcgtgtgaaaatcaagttaacaattcaaaaagaagtctttgaacgggcaattatacagcaatcatttgttgttgaatttgttatcctaaaccagatgtgtgatgaatgtcgccgctatgaggccaaggattattggagagcttgtgtccaagtccgacaacgatgtgattacaagaaaacgctgttttatttggaacaacttttactgaagcacaattttcaatcgaaagctacaagcatcaaaccggttccaactggtcttgactttttcttcccgcggcaacaggaagcaagaaaacttgttgattttatcacttcttcattgccatccaaatatcaacattctcagcaattaataacacatgatgttcgcaacaatttttacgactacaaacatacattttgcattgatattgttccaatcaccaaggatgccctaatttgtnnnccaactcatttggcacagcaatattcgaatattggccaatttgttatttgtttgcgagtgaccgatgttatttgtttgttgaacccgaggactttgcaattatatgaagtgaatccnacaacttattggaaagagccatttgaaattttgacccatccaaaggcattgactgaattctatgtaattgaagtgnnnnnnnnnnnnnnnnnnnnnnnnnnnnnnnnnnnnnnnnnnnnnnnnnnnnnnnnnnnnnnnnnnnnnnnnnnnnnnnnnnnnagtgatcaagttggacattcagaggcacaatcaatttgctgtcgaacacatcttgggcatcttctcaatcctggcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatggaagatgtcgaggaggatccaaaaattcgggaaaagatcaatatttacaagaagcgtcgaccaattcaaaactcaatttccgacgagggcgatgatgaggaaaatggaccaactctggccgaaatgttggaggatttagatattgatgatgttgagatgggcgagnnnnnnnnnnnnnnnnnnnnnnnnnnnnnnnnnnnnnnn

SEQ ID NO: 471 - DNA, 2652 bp, Artificial Sequence
  Description of Artificial Sequence: Synthetic polynucleotide
  modified_base (1)..(120): a, c, t, g, unknown or other
  modified_base (175)..(177): a, c, t, g, unknown or other
  modified_base (274)..(276): a, c, t, g, unknown or other
  modified_base (409)..(474): a, c, t, g, unknown or other
  modified_base (754)..(756): a, c, t, g, unknown or other
  modified_base (919)..(1650): a, c, t, g, unknown or other
  modified_base (1768)..(1770): a, c, t, g, unknown or other
  modified_base (1849)..(1875): a, c, t, g, unknown or other
  modified_base (2005)..(2007): a, c, t, g, unknown or other
  modified_base (2212)..(2355): a, c, t, g, unknown or other
  modified_base (2548)..(2652): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccagaattttgttgttatcttctctacattctcagcaaacttacagaagagnnncaggtggctcatcgagcattgagcggtttattgttgaaaaatacaataaagcaaaattgggcaaatatcccagagcaaattaaattttataagcgannnaattgttttggtgcaatcggcgacaattcttcattggtccgagcaaccgttggaattatcattacgacaatattcttgcatgaaggttgccaaaattggcctcaattattgccgaccctttgccaatatttgnnnnnnnnnnnnnnnnnnnnnnnnnnnnnnnnnnnnnnnnnnnnnnnnnnnnnnnnnnnnnnnnnngcggatcgacttggccaagaggacataaatttgattgtcacaaaagtgttgccatttttcaattcgccgccaccaaaacttcgctcattgtcagtgaatacagtcaattgcattttattggtccaaaatgagagcatttcaactttgattgatccatttttacaatgcctcttccaactggccgatgatgaagatcaggaagttcaaaaacaactttgccgttcgctcactcttctgctcgaaagttacatcaacaaaattgcacctcaattggggaatnnnattgaattcatgctactccgtacccaagacaacaacgaagaaacagcattggaagcctgcgaattttggctggcatttgccgaaaaccctcaactttgcaaggaagtgttggctccaattctgccaaaattaattccggtgctgatcaaatgcatgagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccctatgtggacatgattatgcagccgttgatgcaaaaatggtcagtgctgaaggatgatgacaaggaactattcccattgctggaatgcatttcctccgtggccaccgccttcnnntgctcatttttgccctacactgagcccgtcttccaaagatgcgtccatttgatttcgacaacgctcagtcagagtcaannnnnnnnnnnnnnnnnnnnnnnnnnngaacaaccggacaaggatttcctgattgttgcattggatttgctttctgaattgaccgaagcattgcgagattatattgaccctttggtggaacaaagcaatttaatccatttggtctacatttgtgcannngacatgaccaacgaagttcgccaaagttcatttgcattattgggtgatttggccaaagctgtttattctcatttgcaaccaaatgtccatcaattcatcccaatattggcccaaaacctcaacccggatcatgtctccgtttgcaacaacgcaatttgggcattgggcgaaatttccatgaaaattggtgaacaaatgcgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatccgaccttggtgcctttcactacggaatgtgcgcgacaatgaggaaaaagaatctgcattccgtggactttgcctcatgatcaactgcaatccgcagggagtggccgcctatttcattttcctttgtgatgcaattgcctcttggcaggagcccagcgaggaattgcgattcatgtttggccgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 472 - DNA, 1011 bp, Artificial Sequence
  Description of Artificial Sequence: Synthetic polynucleotide
  modified_base (1)..(132): a, c, t, g, unknown or other
  modified_base (292)..(333): a, c, t, g, unknown or other
  modified_base (348)..(348): a, c, t, g, unknown or other
  modified_base (402)..(402): a, c, t, g, unknown or other
  modified_base (426)..(1011): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcttccacaatcttgtctggacacgctgattcgccgtaacattaaatatccaatgctcttcaaattaaccaatctccaatttcaaaagtcaacccatgccggtgtgctcgaatttttggcggaagaaggcagatgttatttgccaaattgggtaattnnnnnnnnnnnnnnnnnnnnnnnnnnnnnnnnnnnnnnnnnntctagatcattgccngcggctacatatgcaaaattcaagccaatgtccactgacttctacaatgttacnaatccaaaggctatgctcgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 473 - DNA, 1773 bp, Artificial Sequence
  Description of Artificial Sequence: Synthetic polynucleotide
  modified_base (1)..(84): a, c, t, g, unknown or other
  modified_base (177)..(177): a, c, t, g, unknown or other
  modified_base (274)..(930): a, c, t, g, unknown or other
  modified_base (1371)..(1371): a, c, t, g, unknown or other
  modified_base (1516)..(1773): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnncttcgtctaaactccattcggaaactttcaacaattgctttggctctcggtgtcgaaagaactcgcaaagaactgattcaatttttgaccgcnacaatatacgatgaagatgaagttcttttggcattggccgaacaattgggcaatttcacaccacttgttggaggacccgaatatgttcattgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtgctgcacttcctgaagagggacgcaaaaaaggaattgttgaggaaattcttccggtcattaaaccactgacaacggacgcaaaccaacacgtgaaaattgcattggcgaatgttgtgatgggattggcaccacttttgggaaaccaaagcactattgaacatttactgccaatatttttggcaatgcttcgcgatgataccccggaagttcgtctgaacataatttcttcattggacaaagtcagtgatgtgatcggtgccgatgaattgcaatattccctgttgccggcaatcattgatttggctcaagatggaaaatggcgtgtccgactggcactcgttgaatatatgccacttttggccgaacaattgggtcagaaattttttgatgagaaattgctgaagctttgcatgaattggctcactgaccacttntacgcaattcgagaggcagcgaccggcattttgaaacaattggccgagaaatttggcgccgattgggcagtgaagtccgtccttccacgggttattgaattggcttcggacagtaattatttgcatcgaatgacctgtctattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 474 - DNA, 6816 bp, Artificial Sequence
  Description of Artificial Sequence: Synthetic polynucleotide
  modified_base (1)..(69): a, c, t, g, unknown or other
  modified_base (178)..(363): a, c, t, g, unknown or other
  modified_base (690)..(690): a, c, t, g, unknown or other
  modified_base (735)..(735): a, c, t, g, unknown or other
  modified_base (904)..(906): a, c, t, g, unknown or other
  modified_base (942)..(942): a, c, t, g, unknown or other
  modified_base (1048)..(1497): a, c, t, g, unknown or other
  modified_base (1590)..(1590): a, c, t, g, unknown or other
  modified_base (1765)..(1767): a, c, t, g, unknown or other
  modified_base (1834)..(1836): a, c, t, g, unknown or other
  modified_base (1903)..(2136): a, c, t, g, unknown or other
  modified_base (2304)..(2304): a, c, t, g, unknown or other
  modified_base (2467)..(2467): a, c, t, g, unknown or other
  modified_base (2469)..(2469): a, c, t, g, unknown or other
  modified_base (2611)..(2682): a, c, t, g, unknown or other
  modified_base (2818)..(2820): a, c, t, g, unknown or other
  modified_base (2914)..(2991): a, c, t, g, unknown or other
  modified_base (3115)..(3339): a, c, t, g, unknown or other
  modified_base (3553)..(3555): a, c, t, g, unknown or other
  modified_base (3761)..(3762): a, c, t, g, unknown or other
  modified_base (3765)..(3765): a, c, t, g, unknown or other
  modified_base (3832)..(4011): a, c, t, g, unknown or other
  modified_base (4078)..(4593): a, c, t, g, unknown or other
  modified_base (4749)..(4749): a, c, t, g, unknown or other
  modified_base (4873)..(4929): a, c, t, g, unknown or other
  modified_base (5005)..(5742): a, c, t, g, unknown or other
  modified_base (5827)..(5976): a, c, t, g, unknown or other
  modified_base (6142)..(6519): a, c, t, g, unknown or other
  modified_base (6702)..(6702): a, c, t, g, unknown or other
  modified_base (6745)..(6816): a, c, t, g, unknown or other
nnnnnnnnnnnnnnnnnnnnnnnnnnnnnnnnnnnnnnnnnnnnnnnnnnnnnnnnnnnnnnnnnnnnnagatatcgccggattttttcagttggaaatttggcaattacaacatataatccacaaacattggagattacaaatcaatggctttatgaagactttttttcgatccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaaggatggtctgataagaagcaatttttgacattagaagtggcatccagttcattgaatcaacttgagaccacaaatacattgcttaaaagctatgactacaaggatatccgactaataattccattgaaagagcaacgaaatgcatttgtcctagaagttggtgatcagcggagaagacatcttttttattgcgatcaatcggatcgattgataaaagaaatgcgcgatgcagcattggaacatttgggcattgatttgcaaatggcaagagatccactcagcatagaccattttgtgctcactcgacttggtctttgccgnaaagacgaacaattaacttcatatgtggaatttaaagtgcaaaancaacaaacttcctcaacatcaactgcgcggcgtttactttgtctcagcgaaacatgcttgattgagagggatccggcaagttacagtgttatttgtgctcgactgttgagaactattgtttgcttagttcgagatttacgcgatccccagaaatttaatatagtttatnnnaatggcgatgaacggatatacacatcaaatgaatgngattctcttcttgcttcacttattgatggtgctcgcggttccggaaattatcaaattcatattttgtctcgatgccaatatagagatctcagaatggtgccatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaactcaataaacaatctttgctttcaagccgcgcatttgttgaacatttattacacttggttgttgaccatgtgaccaaaggaacagtngccattgttattgcctcaatgcttgactttcttactttcaccatttgtgcaccctatagtgaaaccacaccgggcgatacatttgatgcaatgttagaattggtggcgcagagagggcggacattttacaaacttttccatcatccttctcttacaatagtcaaaggagcgggcnnngtgatgcgcgctataattgaggagtccactcgagagataagtcgacaaatgcaaattttggctctcnnngaaggagcttttctcaaacatttggaaatggctttattgaccactggaaaagatttgcgaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgaagcgaggctggacactcttttacaacattggaatttggaacaaaaattaaattttttacaaagccataaatcgaaggaagagcgaacacttcagcaaagaccagtggtgttgaggaagaggagaagacaagtcaaagcaacggctaattggaaattattttgntatcaattttcacaaaaccatgctcgagccgatttaatttggaatgaaaagacgagagatgaattcagacaggccattgataatgaaatgcgccaattgcaacaagaaatggaatttgtgcaaccaggaacgacgattgcatggaatcatgctgaattttcgntnacttataattcattggctgatgaaattcgaattggtgattattatttgcgatttttgcttaccgaagaaaacgaaactgccacaccaattcatcgaccacaggaatttttcaacaatatttaccatcgatttttactggcannnnnnnnnnnnnnnnnnnnnnnnnnnnnnnnnnnnnnnnnnnnnnnnnnnnnnnnnnnnnnnnnnnnnnnnggtccatttgcggatgcacgtcacattgttcaaatgctggcaaaatgcacaaatttggcagaaagggatcatctcatttttctcataaataagttggcacttgataaacaaaatgtccgtgaattaattgccgcgnnnatccttccacttctcgttgacatcgccgtactcgcccatttacatgtgaatcgagcaaaattgcatgcacaaacaaatgtgattgaggcggccnnnnnnnnnnnnnnnnnnnnnnnnnnnnnnnnnnnnnnnnnnnnnnnnnnnnnnnnnnnnnnnnnnnnnnnnnnnnnntttattcagatgaaagcattttatcgtcaaggaattctttttgagaagagtgaaatttgggctgaaggcctggacaaatggtgccatctctcgtcagttgcacaattccgttggacaatttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctatgatccatcaattgtgcaacgggtagccacattggtgaatgcaattattcaggataatccatctgtgcctcgactttacctttccggtgttttctttttcattttgatgtacaatggctcaaatattttgccaattgcacgttttttgaaggatactcatttgaaacaagcattccgttccactctcagcaaatccgaaggcatccgtnnntctgtgctttgtccaatgctgccagaagcaaacattttctaccttgaggaatatggtgccgaaaaatatgctgaagtgttccttggcgaattcgaaaatcccgaatgtatttggaatagcgaaatgcgaaggcatatgatcgaaaaaattgcaatccatgtggccgatttttcttgccgactttcatcaaatgttaaagctttatnnagntattgtccaattccaccaatagaatatccgcaattgaaggaagaattgttctgtcatttttattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggccattgttaggcgagcatatttcaaattggcacaaaaatatcatccggacaaaaacccagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcagcatttgaaccgtttggcctgtgctgcagcggattgtatttgtgccttttctgtatgtacccttttacaaactcaattattccaagctggtattatttggcaattattgcctcatttgttccgattcgattggacattggatgaaggagangtttcccattccgagaagaccaaccaacaagctgtgttgaatcgattggcccgaagttgttgtgaggcattggcatgtttggctggatataggacagagacaccggataatgatggcgtacagnnnnnnnnnnnnnnnnnnnnnnnnnnnnnnnnnnnnnnnnnnnnnnnnnnnnnnnnnaatgattttgtgctgaaattgttgaattccaacactgaagatccttatttgatttgggacaatgctgcacgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccggaccaaaatggactcgatttcttgtccgttttctcccaaacatttttgctgatacattgagagacaatcctggaatggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggcgagaccggttgcgcatatgagaatgtgatcgccggcgaattgataattggcggaatttaccttcgaatatttattggcaatccgtcttgggcggtacgacatcctcgacaatttgcaacagaattggttgaacggctgttggaattatggcagccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtgaataacccttctgctgcaaaggcagagattgcggatgcattgaaactttgtagccgtgaacctcaatttggcgaacgaatatccacaattttgcaacggtcaaatgtttggagccagtacaaagatcaaaggcatgatttattcttgcccacaacacaaacacaagcaataaccgtnggctctgcatcaattgccggctatttgactgagggaatgttcnnnnnnnnnnnnnnnnnnnnnnnnnnnnnnnnnnnnnnnnnnnnnnnnnnnnnnnnnnnnnnnnnnnnnnnn

SEQ ID NO: 475 - DNA, 261 bp, Artificial Sequence
  Description of Artificial Sequence: Synthetic polynucleotide
  modified_base (1)..(93): a, c, t, g, unknown or other
  modified_base (241)..(261): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtattgttcaaacaatgatcgttttaactgcagtgtgctgttatatgttctggctgatcgtctatctccatcaattaaacccactgattgggccgcagattcctgtcaaaactatattttggattcacgagaagtggggagatgccnnnnnnnnnnnnnnnnnnnnn

SEQ ID NO: 476 - DNA, 1281 bp, Artificial Sequence
  Description of Artificial Sequence: Synthetic polynucleotide
  modified_base (1)..(39): a, c, t, g, unknown or other
  modified_base (151)..(612): a, c, t, g, unknown or other
  modified_base (684)..(684): a, c, t, g, unknown or other
  modified_base (753)..(753): a, c, t, g, unknown or other
  modified_base (904)..(1281): a, c, t, g, unknown or other
nnnnnnnnnnnnnnnnnnnnnnnnnnnnnnnnnnnnnnnaaggtgataatgtctcgaaattatcggggcgacattgatgttggctgcatcgaaaaatttatgccattattaatggaacaggaggatgagggccggacatcaccaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgccggaattacggcttggcctaaatgaaaggtccaatttgagaacactggaagtcagtttttgggaaganggaagaagcaaatccgtcgaattggaagacatcaaattccatcaatgtgttcgactttcacgatttaanaatgaccgaacaattagtttcattccaccggacggcgaatttgaattgatgaactatcggctgagcacagttgtgaaaccgttggtctgggttgaaaccgtaattgaaaaattttcccattctcgcgtggaatatatggtcaaggtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 477 - DNA, 1464 bp, Artificial Sequence
  Description of Artificial Sequence: Synthetic polynucleotide
  modified_base (1)..(1065): a, c, t, g, unknown or other
  modified_base (1225)..(1464): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcccgaaaattggctgccaaagtttcgctgtccactcgaattgatgcactccaagatgaatcattgggaaatcaacagggaatcgatgcacgggcctacattgaatcggcaattaaagtggagaatgctcgaagtggagtgaaaaaacaacgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 478 - DNA, 6504 bp, Artificial Sequence
  Description of Artificial Sequence: Synthetic polynucleotide
  modified_base (1)..(252): a, c, t, g, unknown or other
  modified_base (442)..(1032): a, c, t, g, unknown or other
  modified_base (1080)..(1080): a, c, t, g, unknown or other
  modified_base (1213)..(2643): a, c, t, g, unknown or other
  modified_base (2719)..(3141): a, c, t, g, unknown or other
  modified_base (3258)..(3258): a, c, t, g, unknown or other
  modified_base (3562)..(4332): a, c, t, g, unknown or other
  modified_base (4438)..(4503): a, c, t, g, unknown or other
  modified_base (4618)..(6504): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataattttttagctcgatcatgcggaggcggtgtggccgtcgagagtcgaacatgctccggcacttgcactggaccagcaattcgctacgtttcgtgcaatgtgcaggcatgtccggcggccgtcgatttccgtgccgaacaatgcacagcacacaatgatgatgccatcgatggcaaatatcataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaaaccgggcgaatggtcgggttgttcggtgagctgcggaaaagtnattcgaacaaggacattatattgcacggatgtgggcgcaaatagtcgagtggatgattcagtttgtgaggaaaacaatgcaacaaaaccagaatttgagaaagaatgcaaaacggtggattgtgagccagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagttgtgccgcctcactctatggatgctgcaaggatagacgcacaattgcatttgggccaaattatgctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatatggctgttgtcaagatggtgtatcaaaggcgattggaccagattttgccggttgcccaaccaccactcaggcgccttacattgttggcggtaccgtttccccatccagtatngttgcctgttcgcaaccccaagatcaagggcaagtgtgtgcgcccggctacaagctggcctggttctacgacatggctgagggtcgttgttcccaattttggtatggtggatgcgctggcaatgaggaatcgttcggcagcaaggaacaatgcgagcaaatttgtgtggagcccccgggcattggccgatgctatttgccaaaagttgaaggccctcaacgatgcaatcagctggcagcccgatattactacgattatgtcacaaaacaatgcaccgcattttggcatcggggatgtttgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatttgtgaggcaccaaaggacacgggctcgtgcaaacaatttgccacaaaatggttctacaataagcaagatggcacgtgcaatcgattccactatggaggtnnnnnnnnnnnnnnnnnnnnnnnnnnnnnnnnnnnnnnnnnnnnnnnnnnnnnnnnnnnnnnnnnngatgcttgccaattgccaaaagtagccggtccatgtgtcggcaaaacggaacgtttctattttgacatgttggcacggcaatgccttccattccaatacggtggatgccttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 479 - DNA, 1596 bp, Artificial Sequence
  Description of Artificial Sequence: Synthetic polynucleotide
  modified_base (1)..(369): a, c, t, g, unknown or other
  modified_base (538)..(1596): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatccaacattttcatccgcgctccatgatttggacgatgccctctgtttatcctttgcatttgctgcgttgccaatgtcgagggccgcccaaccgcgggtcataaatcgatgcaaaaaattggtcaccgaattcatgcattatgtgattgaagcaaaggcacttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 480 - DNA, 4203 bp, Artificial Sequence
  Description of Artificial Sequence: Synthetic polynucleotide
  modified_base (1)..(381): a, c, t, g, unknown or other
  modified_base (495)..(495): a, c, t, g, unknown or other
  modified_base (568)..(579): a, c, t, g, unknown or other
  modified_base (787)..(1143): a, c, t, g, unknown or other
  modified_base (1230)..(1230): a, c, t, g, unknown or other
  modified_base (1236)..(1236): a, c, t, g, unknown or other
  modified_base (1242)..(1242): a, c, t, g, unknown or other
  modified_base (1246)..(1246): a, c, t, g, unknown or other
  modified_base (1287)..(1287): a, c, t, g, unknown or other
  modified_base (1449)..(1449): a, c, t, g, unknown or other
  modified_base (1618)..(3126): a, c, t, g, unknown or other
  modified_base (3274)..(4026): a, c, t, g, unknown or other
  modified_base (4156)..(4203): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcaggcattaaatccaaatctcgactatttgcgcaagaaagcattacataaaaaagttgttacactcagtaaaaaaatcactatttgccaagaatgtgcctttatcaatgcnactgtaaagaaggctgttggcgcaattctaaagatcgcccatgccgaacctatcactgaaccaatgcttggtnnnnnnnnnnnnattaatgatgaacaagtcgaacaacaacaattgatcacttcatccaaatttaatcttttggatcctcttaaagttttggaaatttttaaaaagattaacttgcaggatcttcctttattgatgatcggtgctgatgaattaaaacatccagtaaattttctcacccaaaggatacctgtacctcctgtctgcattagaccttcggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgctcgacggctgacttttcccgagcccgtctcacatttgaacatggaaacaatgaaggagttggtttggcgaggcccagaaatncatccnggtgcnaatnatattattgatggaaaaacgggacaaaaacgtttcctcagntatggaaatcgagaaataattgccaagaatttgcaaattggtgacactattgagcgacatttagccgatggcgacgttgtgctcttcaatcgccaaccttcccttcacaaaattagtataatggctcatcgggttaaagtgatgccagcacggacatttagntttaatgaatgcgcatgcaccccatataacgccgattttgatggggatgaaatgaatcttcatctaccacaaacttatgaagcaaaagctgaagcagcaattttaatgggtcttaaatcaaatttggttagtcctcgagccggacaaccattaattgcagccatacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaccgctgttggagctatcgctgcgacctccattggggaaccgtcaacacaaatgacattaaaaacctttcattttgccggtgtcgcttctatgaacataacccaaggcgtgccacgaatcaaagagataatcaacgccgttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgaagccgcattttttggtcagcaagatcgcattgtgggcgtcagcgagtgcattataatgggaacaccaatgggaattgggacgggaatgttcaaattgctacagaacacagcgaaaaaggaagtgnnnnnnnnnnnnnnnnnnnnnnnnnnnnnnnnnnnnnnnnnnnnnnnn

SEQ ID NO: 481 - DNA, 354 bp, Artificial Sequence
  Description of Artificial Sequence: Synthetic polynucleotide
  modified_base (1)..(60): a, c, t, g, unknown or other
  modified_base (169)..(354): a, c, t, g, unknown or other
nnnnnnnnnnnnnnnnnnnnnnnnnnnnnnnnnnnnnnnnnnnnnnnnnnnnnnnnnnnnattcgctgcaccaattgtggtcgatcgtgcccaaaggataaggccatcaaaaaatttgtggtgcgcaacattgttgaggcggcagccgttcgtgatatcaccgacgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 482 - DNA, 1293 bp, Artificial Sequence
  Description of Artificial Sequence: Synthetic polynucleotide
  modified_base (1)..(693): a, c, t, g, unknown or other
  modified_base (1066)..(1068): a, c, t, g, unknown or other
  modified_base (1095)..(1095): a, c, t, g, unknown or other
  modified_base (1252)..(1293): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcactcggcatccaaccattcgactttataatgccgaaacacagcaatgttttgtgtcctccataccaaaggaccagcactcggattcaataatggatgtttgttatgcggaaaatgcccgaatgtttgtgaccgggagccgggatggaaatgtaaaagtttgggatggaatttcgaatcgatgcattgaaacattcacccgggcccatgatggagcaccaatttgcagtgcaaaattcacacgaaatggaaagtatgttttgaccgttggaatggacagtgtgccaaaattgtgggaattgtccacaaatcgatgcctaattgcctatactggggccggcgcaaccgggccagggaatttccgatgcaatnnnggcttcaaccatacagaggattactgnatgttacccgatgagaagtccggttccctttgttcctgggatgcccgcaattcggaccgtgaacggttgttggccctcgggcacacggccccaacccgggcatttgttcattcgccaacaatgccaatgtttgtgaccggatccgatgatcataggnnnnnnnnnnnnnnnnnnnnnnnnnnnnnnnnnnnnnnnnnn

SEQ ID NO: 483 - DNA, 1212 bp, Artificial Sequence
  Description of Artificial Sequence: Synthetic polynucleotide
  modified_base (1)..(219): a, c, t, g, unknown or other
  modified_base (315)..(315): a, c, t, g, unknown or other
  modified_base (421)..(423): a, c, t, g, unknown or other
  modified_base (442)..(444): a, c, t, g, unknown or other
  modified_base (486)..(486): a, c, t, g, unknown or other
  modified_base (495)..(495): a, c, t, g, unknown or other
  modified_base (498)..(498): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
  modified_base (576)..(576): a, c, t, g, unknown or other
  modified_base (712)..(897): a, c, t, g, unknown or other
  modified_base (1210)..(1212): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattggatgaattatacacattgctgaccgaaaactatgtggaagatgacgaaaatatgttccgattcgattatggccgcaattttatcaaatgngccctaatgccaacgggatggcgccaaaaatggcattgcggtgttcgggcaggcaccggcggcaaattggtggcattcatcgccgccatcccgccaaaattcgatnnntacgataaaaccgtcaatnnngtcgagatcaatttcctctgcgtccacaaaaaacttcgctcnaaacggctngcnccggtgctgatcagagaaattactcgacgagttaatcaagttggcattttccaagcaacattnacngccggnattatnatcccaaaaccaattggatcatgcaggtttaagaagagatcaatgaatccaaaaaagttgattgagacaaaattttcacatcttgccaaaaatatgaccatgcaacgaacaaacaaactttacaaattgccggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtgacggatttgatcagtttctacagcctcccatcaacaataatgcacaatccaacttataaaaatattcgggccgcctattcattctacaatgtggccggcagtgtcccattgaatcagctgatgaatgatgcattgattttggcaaaaaatttgggtttcgacgttttcaacgcgttggatttgatggaaaacaaaggatttttggaggaactcaaattcggaattggcgatggaaatttgcaatattatttgtacaattggaaatgcccggacatcccacccgaacgaattggacttgtccttcaannn

SEQ ID NO: 484 - DNA, 1254 bp, Artificial Sequence
  Description of Artificial Sequence: Synthetic polynucleotide
  modified_base (1)..(759): a, c, t, g, unknown or other
  modified_base (865)..(1080): a, c, t, g, unknown or other
  modified_base (1180)..(1254): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacaaaaccggctcacattgtggaagcacacaccgctgaggtcaattgtctgtcattcaatccatattctgagttcatcctggccactggttctgccgataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccacggcggccacacggccaaaatcagcgattttttcgggaatcccaatgggccatgggttatctactccgtttctgatcacaacactattcaggttnnnnnnnnnnnnnnnnnnnnnnnnnnnnnnnnnnnnnnnnnnnnnnnnnnnnnnnnnnnnnnnnnnnnnnnnnnn

SEQ ID NO: 485 - DNA, 6597 bp, Artificial Sequence
  Description of Artificial Sequence: Synthetic polynucleotide
  modified_base (1)..(99): a, c, t, g, unknown or other
  modified_base (211)..(735): a, c, t, g, unknown or other
  modified_base (820)..(885): a, c, t, g, unknown or other
  modified_base (1126)..(1377): a, c, t, g, unknown or other
  modified_base (1462)..(1734): a, c, t, g, unknown or other
  modified_base (1806)..(1806): a, c, t, g, unknown or other
  modified_base (1809)..(1809): a, c, t, g, unknown or other
  modified_base (1812)..(1812): a, c, t, g, unknown or other
  modified_base (1815)..(1815): a, c, t, g, unknown or other
  modified_base (1821)..(1821): a, c, t, g, unknown or other
  modified_base (1830)..(1830): a, c, t, g, unknown or other
  modified_base (1833)..(1833): a, c, t, g, unknown or other
  modified_base (1836)..(1836): a, c, t, g, unknown or other
  modified_base (1839)..(1839): a, c, t, g, unknown or other
  modified_base (1872)..(1872): a, c, t, g, unknown or other
  modified_base (1875)..(1875): a, c, t, g, unknown or other
  modified_base (1878)..(1878): a, c, t, g, unknown or other
  modified_base (1888)..(2190): a, c, t, g, unknown or other
  modified_base (2254)..(2256): a, c, t, g, unknown or other
  modified_base (2401)..(2523): a, c, t, g, unknown or other
  modified_base (2788)..(2793): a, c, t, g, unknown or other
  modified_base (2850)..(2850): a, c, t, g, unknown or other
  modified_base (2875)..(2875): a, c, t, g, unknown or other
  modified_base (2974)..(2976): a, c, t, g, unknown or other
  modified_base (2994)..(2995): a, c, t, g, unknown or other
  modified_base (3012)..(3012): a, c, t, g, unknown or other
  modified_base (3019)..(3019): a, c, t, g, unknown or other
  modified_base (3036)..(3036): a, c, t, g, unknown or other
  modified_base (3042)..(3042): a, c, t, g, unknown or other
  modified_base (3060)..(3060): a, c, t, g, unknown or other
  modified_base (3083)..(3085): a, c, t, g, unknown or other
  modified_base (3090)..(3090): a, c, t, g, unknown or other
  modified_base (3093)..(3093): a, c, t, g, unknown or other
  modified_base (3183)..(3183): a, c, t, g, unknown or other
  modified_base (3187)..(3189): a, c, t, g, unknown or other
  modified_base (3247)..(3249): a, c, t, g, unknown or other
  modified_base (3366)..(3367): a, c, t, g, unknown or other
  modified_base (3369)..(3369): a, c, t, g, unknown or other
  modified_base (3375)..(3376): a, c, t, g, unknown or other
  modified_base (3378)..(3379): a, c, t, g, unknown or other
  modified_base (3381)..(3383): a, c, t, g, unknown or other
  modified_base (3386)..(3387): a, c, t, g, unknown or other
  modified_base (3389)..(3389): a, c, t, g, unknown or other
  modified_base (3393)..(3393): a, c, t, g, unknown or other
  modified_base (3397)..(3399): a, c, t, g, unknown or other
  modified_base (3401)..(3402): a, c, t, g, unknown or other
  modified_base (3405)..(3405): a, c, t, g, unknown or other
  modified_base (3408)..(3409): a, c, t, g, unknown or other
  modified_base (3411)..(3411): a, c, t, g, unknown or other
  modified_base (3414)..(3414): a, c, t, g, unknown or other
  modified_base (3417)..(3417): a, c, t, g, unknown or other
  modified_base (3420)..(3420): a, c, t, g, unknown or other
  modified_base (3422)..(3424): a, c, t, g, unknown or other
  modified_base (3426)..(3426): a, c, t, g, unknown or other
  modified_base (3429)..(3432): a, c, t, g, unknown or other
  modified_base (3483)..(3484): a, c, t, g, unknown or other
  modified_base (3486)..(3486): a, c, t, g, unknown or other
  modified_base (3489)..(3489): a, c, t, g, unknown or other
  modified_base (3492)..(3492): a, c, t, g, unknown or other
  modified_base (3495)..(3495): a, c, t, g, unknown or other
  modified_base (3498)..(3499): a, c, t, g, unknown or other
  modified_base (3501)..(3501): a, c, t, g, unknown or other
  modified_base (3503)..(3503): a, c, t, g, unknown or other
  modified_base (3505)..(3506): a, c, t, g, unknown or other
  modified_base (3510)..(3513): a, c, t, g, unknown or other
  modified_base (3522)..(3523): a, c, t, g, unknown or other
  modified_base (3526)..(3526): a, c, t, g, unknown or other
  modified_base (3529)..(3529): a, c, t, g, unknown or other
  modified_base (3531)..(3531): a, c, t, g, unknown or other
  modified_base (3534)..(3534): a, c, t, g, unknown or other
  modified_base (3536)..(3540): a, c, t, g, unknown or other
  modified_base (3542)..(3543): a, c, t, g, unknown or other
  modified_base (3545)..(3546): a, c, t, g, unknown or other
  modified_base (3553)..(3555): a, c, t, g, unknown or other
  modified_base (3558)..(3558): a, c, t, g, unknown or other
  modified_base (3561)..(3562): a, c, t, g, unknown or other
  modified_base (3564)..(3566): a, c, t, g, unknown or other
  modified_base (3577)..(3577): a, c, t, g, unknown or other
  modified_base (3579)..(3579): a, c, t, g, unknown or other
  modified_base (3652)..(3654): a, c, t, g, unknown or other
  modified_base (3663)..(3663): a, c, t, g, unknown or other
  modified_base (3751)..(3918): a, c, t, g, unknown or other
  modified_base (4039)..(4212): a, c, t, g, unknown or other
  modified_base (4215)..(4215): a, c, t, g, unknown or other
  modified_base (4218)..(4218): a, c, t, g, unknown or other
  modified_base (4224)..(4224): a, c, t, g, unknown or other
  modified_base (4227)..(4227): a, c, t, g, unknown or other
  modified_base (4230)..(4230): a, c, t, g, unknown or other
  modified_base (4240)..(4240): a, c, t, g, unknown or other
  modified_base (4245)..(4245): a, c, t, g, unknown or other
  modified_base (4254)..(4254): a, c, t, g, unknown or other
  modified_base (4260)..(4261): a, c, t, g, unknown or other
  modified_base (4269)..(4269): a, c, t, g, unknown or other
  modified_base (4275)..(4275): a, c, t, g, unknown or other
  modified_base (4278)..(4278): a, c, t, g, unknown or other
  modified_base (4281)..(4281): a, c, t, g, unknown or other
  modified_base (4284)..(4284): a, c, t, g, unknown or other
  modified_base (4327)..(4374): a, c, t, g, unknown or other
  modified_base (4537)..(5088): a, c, t, g, unknown or other
  modified_base (5128)..(5133): a, c, t, g, unknown or other
  modified_base (5290)..(6027): a, c, t, g, unknown or other
  modified_base (6123)..(6123): a, c, t, g, unknown or other
  modified_base (6250)..(6597): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaataaaacctttgcaggcactgacggatccaagttatgcaaaacagtttttggtgctgacctacccattgattggcaactatggtgtgggccgccccgaattgatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaacaattccccattttttggaatttgtttgggccatcaattattgtcacttgctgccggcgccaaaacattaaaattgaagnnnnnnnnnnnnnnnnnnnnnnnnnnnnnnnnnnnnnnnnnnnnnnnnnnnnnnnnnnnnnnnnnnagaaaccatggttatgcagttgaggcgaacacattaaatggcgaatggaccgaattattccacaatgctaatgaccattcaaatgagggcgttgtccattcgagcttgcccatttttagtgtccaattccatcccgaacatgccggaggaccaaccgacttggaatgcctttttgacatttttgtggcagccgttcaaagtgccaaagcgggcgagacaatcaatttgcgaaaagaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcgagaaggaacggcccaccggcattctgtgcacatttggagggcaaactgcgttgaattgtgcattagcattcataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcccattccgaacaaattttgattgataaaagtgttcgaggatggaaagaaattgaatatgaagtggtncgngangcntatganaattgcatnacngtntgnaatatggaaaacattgacccggttggcattcanacnggngaatcggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggattattgcgttgtgaaagtgccacgttgggatttgaacaaattcagtcgggtcagcacannnattggcagctcaatgaaatccgttggcgaagcaatgggcattggccgaacatttgaggaagcattacaaaaagcacttcgaatggcaaatgacagccatgagggattttcaccggacattttcagcagaccagtgaccaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatattttggatttgacattggccaatagaaatcaaagagagatggataattgtgtcgaaatgatcaaagaggcaaagcaaattggcttttcggatgcacaaattgcacggctgattggaagcacagagcgaaatatccgagaatggcgccgtctccatggaattgtgccatttgtgaagcaaattgacactgtggcaggtgaatggccggcctcaaccaactacctctatttgacctacaatggccaagaacatgatgttnnnnnntcacaggagaaggcggtgatggtgcttggctccggcgtctaccgtattggctcctcngtcgaatttgatgcctgcgccgttngttgtgtccaaacgttggacaaattgcgctacaaaacaatcatgatcaattgtaatccggagaccgtctccaccgactatgacatttgcaaccgacttnnntttgaagaaatttcattnnaggttgtctcaaccatntatgagntggaaatgccattgggngcaatncttgcctttggcggtcangcagccaacaacattgcccttgnnntggantcnccttcgctgactgtgttcggcacatcccaataagcattgactgaggccgaggatcgttacaaatttagtcgcaattggataaattgaatntttnnncccacccaatggaggaatgcggcatcggaagaggaagcaatcgacttttgtaaacagnnnggatatccatgcctgattcggcccagttatgtactgtccggagcagcaatgaaagtggcacacaatgagcgggacctgagggaatatttaaaaagggccaaattcattgcaaaggannanccggtnntnntnnnccnntncatngagnnngnnaanganntngangtngangnnntntgnnnnggtgaaacggtactggttccaggcgtcatggagcatatcgaacgcgcaggnntncantcnggnganncnantnnggtnnnnccaccgcannatntgncngcngnnnnnanngnnaaaattnnnganatnncnnncaaaattgccnangctttcgccgtcactgggcccttcaatttgcaattgattgccaaaaatgacaatctattcgtgattgaatgcnnnatttaaggntctcgcagttttccattcgtcagcaaaactttggattacgactttgttgaattagccacaaaagcaatgctcttcaagggcagccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcatatttgaagggacttctttccaccggattccagctgcccaaacgagcaatattcctctccattggtggtgtttatgtaagaggggaatttttggatgatataatctgtttaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatnaancttccnatncgnaaaagcgggncatancaaatatcngcatanngaacgcanggatanaanacncgnaggatggcaattgataatggcatcccgttgatgaccgacatcnnnnnnnnnnnnnnnnnnnnnnnnnnnnnnnnnnnnnnnnnnnnnnnncctccaatcaatccacaattcgattgcctctccaatgaatcgctaattcggctgccgggtttaattgatatccatgtgcatatgcgcgaaccgggtggcgaacacaaggaaacatggcaaactgggacgaaggcggctgtggccggaggcattacattggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccacacacattggaagaaaaaaaggcagaaaacgctnnnnnncctccaggctttcccggaatcgagatgatgttgccattgctgcttcaggcggtttatgaaggcaaattgacggaaaaacaattgcgcgatcggctctactcaaatccgcgaaaaatattcgggcttcctgagcagccaaacacatatattgaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacttctcgatttgtacacaattcgtcaaaaattatccacaatcaatggcaaaaaaattgccatggtcggtgatttgcgctacggaaggacattncattcattggcaaaaattttgtgtctctacggcgatattaccctgcattatgtgtcgccaacagaggatttgggaatgccggaagaagtgaaggaatatgtggccaacaaatccaatattgttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 486 - DNA, 1215 bp, Artificial Sequence
  Description of Artificial Sequence: Synthetic polynucleotide
  modified_base (1)..(276): a, c, t, g, unknown or other
  modified_base (436)..(1215): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatattttcgtctcagatcaaagacaaaggccatgttcacatgaattccaccacctggcacacgctcaccggctttgtgctctaccttggcaaaactggcaagtgcaagattgatgagaatgagaagggctggcacattcaatacattgacaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 487 - DNA, 1515 bp, Artificial Sequence
  Description of Artificial Sequence: Synthetic polynucleotide
  modified_base (1)..(996): a, c, t, g, unknown or other
  modified_base (1141)..(1515): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagctgttcgactgggtgacgttgatagctacttgaagaccaaggcagaatttaataagcgttttctggaggataatacactcacactggttgaacgcatccatcaaagcgtcattcggactgcaattcggcaaatttccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 488 - DNA, 1308 bp, Artificial Sequence
  Description of Artificial Sequence: Synthetic polynucleotide
  modified_base (1)..(204): a, c, t, g, unknown or other
  modified_base (340)..(486): a, c, t, g, unknown or other
  modified_base (561)..(561): a, c, t, g, unknown or other
  modified_base (702)..(702): a, c, t, g, unknown or other
  modified_base (763)..(1053): a, c, t, g, unknown or other
  modified_base (1291)..(1308): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgtcacaacatcaatgcggcaatggttttcgaattcctgaaccgttttgcggacacaatgcaatcttattttggcaaactcaacgaagaaaatgtgaaaaacaattttgtgctcatttatgaattacttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatcaaatatcgccgtaatgaacttttccttgatgtgattgaatacgtcaatttgcttatgagccaacaagancaagttttatccgcgcatgttgccggcaaagtggcaatgaaatcatatttgagtggaatgcccgagtgcaaatttggaataaacgacaaattaacaattgaaggcaaaggacgggcagggagtgaagatccagcgaaaacnacgcgtgcttcggtggccattgacgattgccaattccatcaatgcgttaaattgacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggattaaacgaatgggcggaatgaaagaatctcaaatttctgccgaaattgatttgctaaacacgggaacagctgaaaagaagaaatggaatcgaccaccggtttcgatgaattttgaggtcccatttgcaccatccggattgaaagttcgttatttgaaagtgtttgaacccaaacttggctattctgaccatgatgtcgtgaaatgggttcgatacattggacgaagtggattgnnnnnnnnnnnnnnnnnn

SEQ ID NO: 489 - DNA, 735 bp, Artificial Sequence
  Description of Artificial Sequence: Synthetic polynucleotide
  modified_base (1)..(111): a, c, t, g, unknown or other
  modified_base (379)..(735): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccaaagtgaagaaggcggaaatattcaaacgtgctgaacaatatctgaaggaatatcgcaccaaacaaaagcaaactttggcactgaaacgtcaggcaaagaaagttggcaatttctatgtgccggatgagccaaagttggcatttgtggtgcgcatcaagggtgtgaacaagattcatcctcgacctcgaaaagttcttcaattgcttcgtcttcgccaaatcaacaatggcgttttcgtcaaattgaacaaggcaaccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 490 - DNA, 1320 bp, Artificial Sequence
  Description of Artificial Sequence: Synthetic polynucleotide
  modified_base (1)..(1101): a, c, t, g, unknown or other
  modified_base (1195)..(1320): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctggctttccgacatttgctggtctccaaccgatgagaatttgttcgtttcggccagctttgacaaaactgtcaaaatgtgggatatacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 491 - DNA, 1608 bp, Artificial Sequence
  Description of Artificial Sequence: Synthetic polynucleotide
  modified_base (1)..(105): a, c, t, g, unknown or other
  modified_base (234)..(234): a, c, t, g, unknown or other
  modified_base (301)..(1608): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaatgccatcgtcactaaagagccaccaccatatggtcacagaaaaggctatgttcctcggattcaagaagattttggtgatggaggagcttttccagaaattttcagtgctcaatatccactggtnatggggatggataaaccaggcaccggggcgaaaaacacggttgctctacaatttgacacagaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 492 - DNA, 834 bp, Artificial Sequence
  Description of Artificial Sequence: Synthetic polynucleotide
  modified_base (1)..(402): a, c, t, g, unknown or other
  modified_base (625)..(834): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtatcaaggctacgttggagcatatcttctgatcggcggtgtcgatgcaaccggcccccatcttttcaatgttcacgccagcggaggtggctacagtgtgcctttctcggccgatggttccggtagccttgcagcaattgccgaaatggaagacaattttaagccaaaaatgactgaggaagaatgccgcaaaatggtgattaaagcattggaagctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 493 - DNA, 588 bp, Artificial Sequence
  Description of Artificial Sequence: Synthetic polynucleotide
  modified_base (1)..(123): a, c, t, g, unknown or other
  modified_base (198)..(198): a, c, t, g, unknown or other
  modified_base (235)..(237): a, c, t, g, unknown or other
  modified_base (324)..(324): a, c, t, g, unknown or other
  modified_base (529)..(588): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggggcaaagaggagtaaatgtagccgcattctgcaaggattttaacacaacgacttccaatattaaacatgangcaattttgccggtgaacatttatataaaaccagatnnnacctatgacctagaaattggaacgccgaccaccgcgtggttattaaaacaagcagccggaatacgcaaaattagactaggaaaagtngaaattgctgccagattatccgtaaagcacatttacgaaattgccaaagtcaaagcccaggataaaattatggatggagttcctctcaaggaaatatgccagatgatcgttgatagagcaaaaggaatgggcataaaagtgcaaaatgaggatttggatgcaacaaaataccaagaatttctggacgagaaaagagaaattgttnnnnnnnnnnnnnnnnnnnnnnnnnnnnnnnnnnnnnnnnnnnnnnnnnnnnnnnnnnnn

SEQ ID NO: 494 - DNA, 1746 bp, Artificial Sequence
  Description of Artificial Sequence: Synthetic polynucleotide
  modified_base (96)..(96): a, c, t, g, unknown or other
  modified_base (187)..(189): a, c, t, g, unknown or other
  modified_base (235)..(1608): a, c, t, g, unknown or other
  modified_base (1696)..(1746): a, c, t, g, unknown or other
atggccactgaacaagattatcgttcctcaatttcggctcggcccggcttcaaccgcaattcgaccacctattccagcaacactggaggccccccnaccggcaatcgagtattgaaaattgttacggaaacgatgacttcaagtgtcagcggcggcgtttccccgtttggcacaaatgccgcccaannnattcgggatgcccgtgaccgggagaaaaaggagctaagtgatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccggatgaactcatctttgatggcgaggacacatttggggttggcacaaatttgcaaactctgctttataatcgggatggcgaannnnnnnnnnnnnnnnnnnnnnnnnnnnnnnnnnnnnnnnnnnnnnnnnnn

SEQ ID NO: 495 - DNA, 618 bp, Artificial Sequence
  Description of Artificial Sequence: Synthetic polynucleotide
  modified_base (1)..(486): a, c, t, g, unknown or other
  modified_base (616)..(618): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcattcatcactatggccaccgagatcaagaatcgtatgggcccactgcaacaggccggcaacgcatccgccgttcgcattggcccatcgcagccggttcaggacaagaaatcgggcggatgttgcnnn

SEQ ID NO: 496 - DNA, 729 bp, Artificial Sequence
  Description of Artificial Sequence: Synthetic polynucleotide
  modified_base (1)..(249): a, c, t, g, unknown or other
  modified_base (405)..(405): a, c, t, g, unknown or other
  modified_base (478)..(478): a, c, t, g, unknown or other
  modified_base (480)..(480): a, c, t, g, unknown or other
  modified_base (485)..(485): a, c, t, g, unknown or other
  modified_base (487)..(487): a, c, t, g, unknown or other
  modified_base (489)..(494): a, c, t, g, unknown or other
  modified_base (497)..(501): a, c, t, g, unknown or other
  modified_base (503)..(505): a, c, t, g, unknown or other
  modified_base (507)..(507): a, c, t, g, unknown or other
  modified_base (509)..(510): a, c, t, g, unknown or other
  modified_base (513)..(514): a, c, t, g, unknown or other
  modified_base (516)..(516): a, c, t, g, unknown or other
  modified_base (522)..(522): a, c, t, g, unknown or other
  modified_base (525)..(528): a, c, t, g, unknown or other
  modified_base (532)..(534): a, c, t, g, unknown or other
  modified_base (538)..(539): a, c, t, g, unknown or other
  modified_base (543)..(543): a, c, t, g, unknown or other
  modified_base (546)..(546): a, c, t, g, unknown or other
  modified_base (550)..(550): a, c, t, g, unknown or other
  modified_base (552)..(553): a, c, t, g, unknown or other
  modified_base (555)..(555): a, c, t, g, unknown or other
  modified_base (561)..(561): a, c, t, g, unknown or other
  modified_base (565)..(565): a, c, t, g, unknown or other
  modified_base (567)..(567): a, c, t, g, unknown or other
  modified_base (570)..(573): a, c, t, g, unknown or other
  modified_base (579)..(580): a, c, t, g, unknown or other
  modified_base (595)..(597): a, c, t, g, unknown or other
  modified_base (600)..(600): a, c, t, g, unknown or other
  modified_base (727)..(729): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttaaggatgacaacaagaaatatattcaacatttgattaaaaccggctcaaccgaggaatttttggaaatttacactgatgaggtcaaaggccggggtattcgagcgttgaaggcttttcgaaagggcgaatttgttgttgagtataaagcngagatcatcccatcaaagaaggctcaaattcgtgaggaggaatattcaaaaaatgaggccatcggctcctacntntattntntnnnnnntcnnnnnannnantnntgnntngatgcnacnnnngaannnccgnncaanggncgtntnntnaatcanagcnanttnnnnccaaanntgaagacacaggtcnnngantttggcaggagtttccaccttgtgcttgtggccaaacgggacattgaaattggcgaagagttattgtatgattatggcgagcgacgcccggatgtggttgcccaaaatccatggctattgagctcannn

SEQ ID NO: 497 - DNA, 3384 bp, Artificial Sequence
  Description of Artificial Sequence: Synthetic polynucleotide
  modified_base (1)..(399): a, c, t, g, unknown or other
  modified_base (529)..(627): a, c, t, g, unknown or other
  modified_base (1138)..(2076): a, c, t, g, unknown or other
  modified_base (2281)..(2517): a, c, t, g, unknown or other
  modified_base (2656)..(2664): a, c, t, g, unknown or other
  modified_base (2731)..(2733): a, c, t, g, unknown or other
  modified_base (2781)..(2781): a, c, t, g, unknown or other
  modified_base (2980)..(3384): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttcagaggaggttatttcattataaatggttcagagaagattatgcgattgttggttgcaaataaaagaaattttccattggcaattcggaggaaagcatttcgtgacaaaggtcggtactcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcgtcgtgaattattttatattccattaatgtacattctaaaatgtttggtcgactggaatgatgctcaaatttattcccaactcatttcgggacgccaaaatgatcaattttggatgaaatgcgttcaaaatatgctcacaatggcacaagatgagggaattgcctcacaaaagacggcattgttgactttgggccatcgattccgtgttgctttgggcgatcgaattgccccatgggaggatgatgaaattgcatgtcgatttttgttgaatcaatgtttggctgttcatttgaaaacggatgagcaaaaattctattgtttggcaatgatggcacaaaaattagttggattagtcaaaaatgagctgcgcgatgaatcgcaggataatccacaatttcaagaagcctcagtttctggtcatattcttttgctgatttgtcgtgaaagaatggaaaatttattgcaaattgcccgaaaaaaattggaaattattgcaaaaagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaaacgccgcaaaaacctctgctaaaattggaagcaaatgacaaatatgaaatggacgaatacccgttggggacaaatgcatgcgttgcggtgatttcctacaccggatatgatatggaggatgcaatggtcatcaacaaggcttcctatcaacggggattcgcccatggtactgtaatcaaagtggaacgggtgaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatattctaattcaatggagaattcaacgtaatccaattattggtgacaaatttgcctcaaggcatggacaaaaaggaattaattcatttttgtggccacccgagtcaatgccattctccgagtctggaatggtcccgnnnnnnnnntttaaattgaatagttttccatcgcgaatgacaattggaatgatgattgagagtatggctgggaagnnngctgcaatgcacggggccacctatgatgcatcaccattcgtttttaangaacaaaatacggcaattgaccattttggcaaattgctggccaaaaccggctataattattacggggaggagacaatgtattctggggtggatggcagagaaatgcaggtccaagtgttttttggcattgtttattatcagcgattgaggcatatgatttcggataagtttcaagttcgttcgacagggcccatcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 498 - DNA, 1788 bp, Artificial Sequence
  Description of Artificial Sequence: Synthetic polynucleotide
  modified_base (1)..(309): a, c, t, g, unknown or other
  modified_base (445)..(798): a, c, t, g, unknown or other
  modified_base (970)..(1332): a, c, t, g, unknown or other
  modified_base (1519)..(1542): a, c, t, g, unknown or other
  modified_base (1681)..(1788): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtagattctcccgactctcggcaaatgtttttgtgcatgccggcattctggtgcatttgttcgattgctgtgttccaactccggtggtctcattcgccatccccgaattgaaatgcgatgccggactaatggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaagatgaaccaaatccggatttccccactgttccatttcccaatccggaggaaggccatcgagtgttggatttgtgttttcgaacagccgattcggccaaatcaaatttgattttggccaatgatccggacgctgatcgacttcaattggccgaaaaacaaccggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccttcaacaacaattattccaaatttatcgcaaatatggctttcatttatgccaaaattcatattggattgtgcctgggccggagaccacacgaaaaatattcgctgaattacgcgaaaatggaaaatatccggaggcaattggccagagtcgcgtcaaatttgtacgggatttgaccactggtnnnnnnnnnnnnnnnnnnnnnnnncgcgcaattctcccgctgagcacttcctccgaaatggttacattcactttggacaccggcagcattattacacttcgggccagtggaacagagccaaaaatcaaatattacattgaattgcgcactgaacccggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 499 - DNA, 1485 bp, Artificial Sequence
  Description of Artificial Sequence: Synthetic polynucleotide
  modified_base (1)..(387): a, c, t, g, unknown or other
  modified_base (823)..(825): a, c, t, g, unknown or other
  modified_base (883)..(1104): a, c, t, g, unknown or other
  modified_base (1161)..(1161): a, c, t, g, unknown or other
  modified_base (1194)..(1194): a, c, t, g, unknown or other
  modified_base (1227)..(1227): a, c, t, g, unknown or other
  modified_base (1465)..(1485): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggaacctcatcaacagaggataaacaaattgcccaatttggcacatctcaaaaagcacaagatgggactgttcgagcattgctaccatctcgtgccaatttaataacaaaaccaaaatggcatgctccatggaaattatatcgtgtcatttcggggcatactggctgggttagagcagtggatgttgaaccgaacaatgaatggtttgccagtggtggggctgatcgaattgtgaaaatttgggatctggcaagtggacaattaaaactttcattgactggccatattagcgcagtcagagcagtgaaaatatcgcctagacatccatatttgttcagtgcggcgaagataagcagggtaaaatgctgggatttggagcagaacaaagttgttcgacattatcacggccatttgagtgcagttcaggatttgnnnattcatccaacaattgatattttggtcacatgcgccagagactccactgccagggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctggctcaacagacaacataaaattgtggaaattgccaaatggagaatttatgcanaatttgagtggccaaaatacaatgataaattcnttggcaatcaacgaagatggagtcatcatttcnggaggtaattccggcacaatgcatttttgggacttcaaatccggtttttgtttccaaaaggaacatccctccccacagcccggttcaatcgactccgaacgcggcatttttgccctttgttttgacaaatccggcactcgattgatcacagccgaagcagataaatccattaaaatgtggaaggaagacccggaagcgacggaagaaacacatccattaacctggagaccagaaattnnnnnnnnnnnnnnnnnnnnn

SEQ ID NO: 500 - DNA, 543 bp, Artificial Sequence
  Description of Artificial Sequence: Synthetic polynucleotide
  modified_base (1)..(219): a, c, t, g, unknown or other
  modified_base (391)..(543): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctcgccttttgctccatcagctattttgtgatgattctcgtccttcaaacctaccaatggtatgtggagaagctcaccttcttccaagcggttgaagaggacaaaaagcccgcccgctattggaaatggtcatcggacatgaaacggtttgggcaaaaatttcgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 501 - DNA, 1314 bp, Artificial Sequence
  Description of Artificial Sequence: Synthetic polynucleotide
  modified_base (1)..(30): a, c, t, g, unknown or other
  modified_base (268)..(270): a, c, t, g, unknown or other
  modified_base (537)..(537): a, c, t, g, unknown or other
  modified_base (727)..(727): a, c, t, g, unknown or other
  modified_base (730)..(730): a, c, t, g, unknown or other
  modified_base (812)..(814): a, c, t, g, unknown or other
  modified_base (816)..(817): a, c, t, g, unknown or other
  modified_base (820)..(820): a, c, t, g, unknown or other
  modified_base (823)..(823): a, c, t, g, unknown or other
  modified_base (825)..(825): a, c, t, g, unknown or other
  modified_base (829)..(831): a, c, t, g, unknown or other
  modified_base (834)..(834): a, c, t, g, unknown or other
  modified_base (837)..(839): a, c, t, g, unknown or other
  modified_base (843)..(843): a, c, t, g, unknown or other
  modified_base (847)..(847): a, c, t, g, unknown or other
  modified_base (850)..(850): a, c, t, g, unknown or other
  modified_base (852)..(854): a, c, t, g, unknown or other
  modified_base (865)..(867): a, c, t, g, unknown or other
  modified_base (870)..(874): a, c, t, g, unknown or other
  modified_base (877)..(879): a, c, t, g, unknown or other
  modified_base (884)..(885): a, c, t, g, unknown or other
  modified_base (888)..(888): a, c, t, g, unknown or other
  modified_base (891)..(892): a, c, t, g, unknown or other
  modified_base (894)..(895): a, c, t, g, unknown or other
  modified_base (897)..(897): a, c, t, g, unknown or other
  modified_base (902)..(903): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (916)..(917): a, c, t, g, unknown or other
  modified_base (921)..(922): a, c, t, g, unknown or other
  modified_base (925)..(925): a, c, t, g, unknown or other
  modified_base (931)..(932): a, c, t, g, unknown or other
  modified_base (934)..(935): a, c, t, g, unknown or other
  modified_base (939)..(943): a, c, t, g, unknown or other
  modified_base (945)..(947): a, c, t, g, unknown or other
  modified_base (950)..(951): a, c, t, g, unknown or other
  modified_base (953)..(956): a, c, t, g, unknown or other
  modified_base (958)..(959): a, c, t, g, unknown or other
  modified_base (961)..(966): a, c, t, g, unknown or other
  modified_base (970)..(972): a, c, t, g, unknown or other
  modified_base (974)..(974): a, c, t, g, unknown or other
  modified_base (976)..(976): a, c, t, g, unknown or other
  modified_base (978)..(979): a, c, t, g, unknown or other
  modified_base (981)..(981): a, c, t, g, unknown or other
  modified_base (984)..(987): a, c, t, g, unknown or other
  modified_base (990)..(994): a, c, t, g, unknown or other
  modified_base (996)..(996): a, c, t, g, unknown or other
  modified_base (999)..(1000): a, c, t, g, unknown or other
  modified_base (1005)..(1005): a, c, t, g, unknown or other
  modified_base (1072)..(1314): a, c, t, g, unknown or other
nnnnnnnnnnnnnnnnnnnnnnnnnnnnnngccgatatgtcattggcggactttggccgacgcgaaattgttttggccgaaaatgaaatgccaggactgatggcattgcgcgcaaaatattcggttgaaaagccgctgaagggtgccagaattgccggatgtttgcacatgactgtccaaacggctgttttgatcgaaactttgattgaattgggcgcccaagtccaatggtcttcatgcaacattttttccacccaagaccatgcgnnngctgcaatcgccgctcggggcattccggtctatgcttggaagggcgaaaccgaagaggaatatgaatggtgcattgaacagactctaattttcgccgatggccaaccactgaacatgattttggacgatggcggcgatttgaccaacattgtccacgataagcacccggaattgttgaccggaattattggactttccgaggagaccaccaccggtgtccacaatttggcaaaacggctggccgatgcaaaattgatggtcccaganatcaacgtgaacgattcggtcaccaaatccaaattcgacaatttgtacggcattcgggagtcgttggtggacggaatcaaacgggcaaccgatgtgatgaccgctggcaaagtggccgtcgtttgtggctatggggacgtgggcaaaggatcagcccagggattgaaagcattgggtgcccgtgtgattntancagagattgacccgataaatgcgatgcaagcatcgatggaaggctatcaagtgaccacactggaggaagtggcccaaattgnnnanntcnttntngctnnnacnggnnncaangacnttntnnnaggtgaacatnnngannnnntgnnngacgnngcnatnntnngnaatgnnggncanttngatnntgannttnacaaanngnngctnnnnnannnttnngnnnncnntnnnnnngttnnncncnanntngannnntannnnntnaannatggncgtaaaatgtatctgctcgcggagggacgcttggtaaatctgggagctgctgacggacatccggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 502 - DNA, 1542 bp, Artificial Sequence
  Description of Artificial Sequence: Synthetic polynucleotide
  modified_base (1)..(135): a, c, t, g, unknown or other
  modified_base (423)..(423): a, c, t, g, unknown or other
  modified_base (430)..(430): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (442)..(445): a, c, t, g, unknown or other
  modified_base (447)..(451): a, c, t, g, unknown or other
  modified_base (453)..(455): a, c, t, g, unknown or other
  modified_base (457)..(457): a, c, t, g, unknown or other
  modified_base (459)..(460): a, c, t, g, unknown or other
  modified_base (462)..(463): a, c, t, g, unknown or other
  modified_base (465)..(467): a, c, t, g, unknown or other
  modified_base (471)..(472): a, c, t, g, unknown or other
  modified_base (474)..(474): a, c, t, g, unknown or other
  modified_base (670)..(1266): a, c, t, g, unknown or other
  modified_base (1332)..(1332): a, c, t, g, unknown or other
  modified_base (1390)..(1392): a, c, t, g, unknown or other
  modified_base (1413)..(1413): a, c, t, g, unknown or other
  modified_base (1416)..(1416): a, c, t, g, unknown or other
  modified_base (1419)..(1419): a, c, t, g, unknown or other
  modified_base (1422)..(1425): a, c, t, g, unknown or other
  modified_base (1429)..(1432): a, c, t, g, unknown or other
  modified_base (1434)..(1436): a, c, t, g, unknown or other
  modified_base (1438)..(1440): a, c, t, g, unknown or other
  modified_base (1443)..(1443): a, c, t, g, unknown or other
  modified_base (1446)..(1449): a, c, t, g, unknown or other
  modified_base (1452)..(1452): a, c, t, g, unknown or other
  modified_base (1455)..(1455): a, c, t, g, unknown or other
  modified_base (1458)..(1459): a, c, t, g, unknown or other
  modified_base (1461)..(1461): a, c, t, g, unknown or other
  modified_base (1463)..(1464): a, c, t, g, unknown or other
  modified_base (1466)..(1467): a, c, t, g, unknown or other
  modified_base (1472)..(1476): a, c, t, g, unknown or other
  modified_base (1534)..(1542): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaataacaaacctgatgatgatacaataaaaatgttcgttggacaaattccaaagagttgggatgaatcaaaattgaaaaaatttttcgcacaatatgggcctgtttatcatttaaatatactgcgggaaaaggagacggataatagccgaggctgttgctttgtgacattttatcaccgcaaggatgctataaacgcccagaatgcccttcataatatttttataatgcccggactcaaccatccagttcagatgaaaccggcggatatagaaaatcgaaatgtncggaaantnttngtnggannnntnnnnnannntngnnannannnaaanntnaaaaaatttttcgcacaatatgggcctgtttatcatttaaatatactgcgggaaaaggaggataatagccgaggctgttgctttgtgacattttatcaccgcaaggatgctataaacgcccagaatgcccttcataatatttttataatgcccggactcaaccatccagttcagatgaaaccggcggatatagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaggccctgacggttgtaatctattcgtctatcatttgcctcaagagtttaccgacacggatgtntacgccacatttcgcaattttggcaatattctctctgccaaagtgttcatcgaccaannnacaaatttgagcaaatgtttnggnttngtnnnntacnnnnannnannntcngcnnnnaangcnatnnangnnannaatgnnnnncaaattggaatgaaacgactgaaagtgcagttgaagaagccaagggacaagccatatnnnnnnnnn

SEQ ID NO: 503 - DNA, 2964 bp, Artificial Sequence
  Description of Artificial Sequence: Synthetic polynucleotide
  modified_base (1)..(2340): a, c, t, g, unknown or other
  modified_base (2512)..(2964): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacggggctggcgaaatgaatggacttttggccacctattttggcattcaattgggcagaattcttgagcaagtccatgcggccaatattatccatggtgatgtgaaaccggacaatattatgctcacagccaatttggacgaacgaaaatcattggaccaattattgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 504 - DNA, 3618 bp, Artificial Sequence
  Description of Artificial Sequence: Synthetic polynucleotide
  modified_base (1)..(480): a, c, t, g, unknown or other
  modified_base (574)..(576): a, c, t, g, unknown or other
  modified_base (657)..(657): a, c, t, g, unknown or other
  modified_base (948)..(948): a, c, t, g, unknown or other
  modified_base (1222)..(1593): a, c, t, g, unknown or other
  modified_base (1798)..(3264): a, c, t, g, unknown or other
  modified_base (3439)..(3618): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaggttgctggaacgcgtgtttttgatgaaaaaaaggaagaaagcacgaaaattctgcaagatactcaaggaaaaatcgaaagagtgaaannncttttgggctatatcaacgaaagactgaaaaaattggaagaagagaaggaagatttgaaagaatatcaaaatgggacaaanatttacagggcaatcgaatataccatttatgaaatggagataaatgaagcaaaggggaaattggaaaaattaacaattcatcgagaaaagattaataaacaacagaatgaggtaatttattataaaagtggcaataaaacaaattgtctgcagtatgaaaccagattgatcaatattaaaatgtcaatacaagaagtggaacgggaaatccgtcaattgaatactcattacaatggagtgaaggaagaaaaggaatcattgatgaatgaacagtcggaattaatggaaagntaaaattaatattcatatttataggaaatggcggaagtggaaatcaaaaaattggaaaagcaaattgccgaaaaggaagaacagttgaagaatttgcaaccaaattatcaaaaattattggaggaagataatcgactcaattcggatattcgaataatcgatcaacgatgcaaagaactttatgggaaacaaggacatcgagaacagtacaaaacggtggaagaaagggataaatatttgaagaatgagattagatggattgatggccaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattaaatacaattcaaggtcgtgttattgatttgtttgagtgcgaaaatcgattcaataaagcaattgaagttacggctcaaagtcgactattctatcacgtggttgaggatgatggaattgcaacggcaataatcaatcgaattaataagagaggccttccaggggaggtcaatttttatccattaaatcgtcttttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcatttactgggaccaccgaaacaagggacatcacttcattgtctggaggccaaaaaacgttggttgcgctggctttgatatttgccattcaaaaatgtgacccggctccattctatttgtttgatgagattgatgccgcccttgaccaggaacatcgccgggctgttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 505 - DNA, 555 bp, Artificial Sequence
  Description of Artificial Sequence: Synthetic polynucleotide
  modified_base (118)..(441): a, c, t, g, unknown or other
  modified_base (547)..(555): a, c, t, g, unknown or other
atggttatgctaacagttattaaaaaatctcgccgaaaggagcaagaaatgagaattttaatacttggactcgacaattctggaaaaacaacttttcttaaaaaaatgaatggagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaacatcactggaaaattttcgaaaccagtgcttatgtgggaacaaatttattggaagctatggaatggctttgcaccgatgtgtcttcgagaatattagttnnnnnnnnn

SEQ ID NO: 506 - DNA, 2517 bp, Artificial Sequence
  Description of Artificial Sequence: Synthetic polynucleotide
  modified_base (30)..(30): a, c, t, g, unknown or other
  modified_base (36)..(36): a, c, t, g, unknown or other
  modified_base (45)..(45): a, c, t, g, unknown or other
  modified_base (69)..(69): a, c, t, g, unknown or other
  modified_base (153)..(153): a, c, t, g, unknown or other
  modified_base (165)..(165): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (186)..(186): a, c, t, g, unknown or other
  modified_base (210)..(211): a, c, t, g, unknown or other
  modified_base (237)..(237): a, c, t, g, unknown or other
  modified_base (246)..(246): a, c, t, g, unknown or other
  modified_base (270)..(270): a, c, t, g, unknown or other
  modified_base (279)..(279): a, c, t, g, unknown or other
  modified_base (297)..(297): a, c, t, g, unknown or other
  modified_base (381)..(381): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (438)..(439): a, c, t, g, unknown or other
  modified_base (465)..(465): a, c, t, g, unknown or other
  modified_base (474)..(474): a, c, t, g, unknown or other
  modified_base (498)..(498): a, c, t, g, unknown or other
  modified_base (507)..(507): a, c, t, g, unknown or other
  modified_base (525)..(525): a, c, t, g, unknown or other
  modified_base (609)..(609): a, c, t, g, unknown or other
  modified_base (621)..(621): a, c, t, g, unknown or other
  modified_base (627)..(627): a, c, t, g, unknown or other
  modified_base (630)..(630): a, c, t, g, unknown or other
  modified_base (636)..(636): a, c, t, g, unknown or other
  modified_base (642)..(642): a, c, t, g, unknown or other
  modified_base (666)..(667): a, c, t, g, unknown or other
  modified_base (693)..(693): a, c, t, g, unknown or other
  modified_base (702)..(702): a, c, t, g, unknown or other
  modified_base (726)..(726): a, c, t, g, unknown or other
  modified_base (735)..(735): a, c, t, g, unknown or other
  modified_base (753)..(753): a, c, t, g, unknown or other
  modified_base (837)..(837): a, c, t, g, unknown or other
  modified_base (849)..(849): a, c, t, g, unknown or other
  modified_base (855)..(855): a, c, t, g, unknown or other
  modified_base (858)..(858): a, c, t, g, unknown or other
  modified_base (864)..(864): a, c, t, g, unknown or other
  modified_base (870)..(870): a, c, t, g, unknown or other
  modified_base (894)..(895): a, c, t, g, unknown or other
  modified_base (921)..(921): a, c, t, g, unknown or other
  modified_base (930)..(930): a, c, t, g, unknown or other
  modified_base (954)..(954): a, c, t, g, unknown or other
  modified_base (963)..(963): a, c, t, g, unknown or other
  modified_base (981)..(981): a, c, t, g, unknown or other
  modified_base (1065)..(1065): a, c, t, g, unknown or other
  modified_base (1077)..(1077): a, c, t, g, unknown or other
  modified_base (1083)..(1083): a, c, t, g, unknown or other
  modified_base (1086)..(1086): a, c, t, g, unknown or other
  modified_base (1092)..(1092): a, c, t, g, unknown or other
  modified_base (1098)..(1098): a, c, t, g, unknown or other
  modified_base (1122)..(1123): a, c, t, g, unknown or other
  modified_base (1149)..(1149): a, c, t, g, unknown or other
  modified_base (1158)..(1158): a, c, t, g, unknown or other
  modified_base (1182)..(1182): a, c, t, g, unknown or other
  modified_base (1191)..(1191): a, c, t, g, unknown or other
  modified_base (1209)..(1209): a, c, t, g, unknown or other
  modified_base (1293)..(1293): a, c, t, g, unknown or other
  modified_base (1305)..(1305): a, c, t, g, unknown or other
  modified_base (1311)..(1311): a, c, t, g, unknown or other
  modified_base (1314)..(1314): a, c, t, g, unknown or other
  modified_base (1320)..(1320): a, c, t, g, unknown or other
  modified_base (1326)..(1326): a, c, t, g, unknown or other
  modified_base (1350)..(1351): a, c, t, g, unknown or other
  modified_base (1377)..(1377): a, c, t, g, unknown or other
  modified_base (1386)..(1386): a, c, t, g, unknown or other
  modified_base (1410)..(1410): a, c, t, g, unknown or other
  modified_base (1419)..(1419): a, c, t, g, unknown or other
  modified_base (1437)..(1437): a, c, t, g, unknown or other
  modified_base (1521)..(1521): a, c, t, g, unknown or other
  modified_base (1533)..(1533): a, c, t, g, unknown or other
  modified_base (1539)..(1539): a, c, t, g, unknown or other
  modified_base (1542)..(1542): a, c, t, g, unknown or other
  modified_base (1548)..(1548): a, c, t, g, unknown or other
  modified_base (1554)..(1554): a, c, t, g, unknown or other
  modified_base (1578)..(1579): a, c, t, g, unknown or other
  modified_base (1605)..(1605): a, c, t, g, unknown or other
  modified_base (1614)..(1614): a, c, t, g, unknown or other
  modified_base (1638)..(1638): a, c, t, g, unknown or other
  modified_base (1647)..(1647): a, c, t, g, unknown or other
  modified_base (1665)..(1665): a, c, t, g, unknown or other
  modified_base (1749)..(1749): a, c, t, g, unknown or other
  modified_base (1761)..(1761): a, c, t, g, unknown or other
  modified_base (1767)..(1767): a, c, t, g, unknown or other
  modified_base (1770)..(1770): a, c, t, g, unknown or other
  modified_base (1776)..(1776): a, c, t, g, unknown or other
  modified_base (1782)..(1782): a, c, t, g, unknown or other
  modified_base (1806)..(1807): a, c, t, g, unknown or other
  modified_base (1833)..(1833): a, c, t, g, unknown or other
  modified_base (1842)..(1842): a, c, t, g, unknown or other
  modified_base (1866)..(1866): a, c, t, g, unknown or other
  modified_base (1875)..(1875): a, c, t, g, unknown or other
  modified_base (1893)..(1893): a, c, t, g, unknown or other
  modified_base (1977)..(1977): a, c, t, g, unknown or other
  modified_base (1989)..(1989): a, c, t, g, unknown or other
  modified_base (1995)..(1995): a, c, t, g, unknown or other
  modified_base (1998)..(1998): a, c, t, g, unknown or other
  modified_base (2004)..(2004): a, c, t, g, unknown or other
  modified_base (2010)..(2010): a, c, t, g, unknown or other
  modified_base (2034)..(2035): a, c, t, g, unknown or other
  modified_base (2061)..(2061): a, c, t, g, unknown or other
  modified_base (2070)..(2070): a, c, t, g, unknown or other
  modified_base (2094)..(2094): a, c, t, g, unknown or other
  modified_base (2103)..(2103): a, c, t, g, unknown or other
  modified_base (2121)..(2121): a, c, t, g, unknown or other
  modified_base (2205)..(2205): a, c, t, g, unknown or other
  modified_base (2217)..(2217): a, c, t, g, unknown or other
  modified_base (2223)..(2223): a, c, t, g, unknown or other
  modified_base (2226)..(2226): a, c, t, g, unknown or other
  modified_base (2232)..(2232): a, c, t, g, unknown or other
  modified_base (2238)..(2238): a, c, t, g, unknown or other
  modified_base (2262)..(2263): a, c, t, g, unknown or other
  modified_base (2289)..(2289): a, c, t, g, unknown or other
  modified_base (2298)..(2298): a, c, t, g, unknown or other
  modified_base (2322)..(2322): a, c, t, g, unknown or other
  modified_base (2331)..(2331): a, c, t, g, unknown or other
  modified_base (2349)..(2349): a, c, t, g, unknown or other
  modified_base (2433)..(2433): a, c, t, g, unknown or other
  modified_base (2445)..(2445): a, c, t, g, unknown or other
  modified_base (2451)..(2451): a, c, t, g, unknown or other
  modified_base (2454)..(2454): a, c, t, g, unknown or other
  modified_base (2460)..(2460): a, c, t, g, unknown or other
  modified_base (2466)..(2466): a, c, t, g, unknown or other
  modified_base (2490)..(2491): a, c, t, g, unknown or other
  modified_base (2509)..(2517): a, c, t, g, unknown or other
atgcaaattttcgtcaagacactcaccggnaagacnatcaccctngaagtggaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggaatgcaaatnttcgtcaanacactcaccggcaagaccatcacnctggaagtngaggcatcggacaccatngaaaatgtcaaagccaagatccaggacaaggaaggcattccaccggaccagcagcgcctgatcttcgctgggaagcaattggangatggacgcacnttggcngantacaanatccanaaggaatcaactcttcatttggtnntgcgtcttcgcggtggannnnnnnnn

SEQ ID NO: 507 - DNA, 627 bp, Artificial Sequence
  Description of Artificial Sequence: Synthetic polynucleotide
  modified_base (115)..(216): a, c, t, g, unknown or other
  modified_base (400)..(627): a, c, t, g, unknown or other
atgggtatttctcaagacaattggcataaacgacgaaagactggaggaaagcgtaatccaatccacaagaagcgcaagcatgaattgggccgtccggcagcaaatacgaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccgcaaaacccgcgtcatcgacacggtttacaatgcatccaacaatgagctggttcgcaccaaaacattggtcaagggatctatcatcaccatcgacgccgtcccattccgccaatggttcgaggcgcattatgcccaaccgctcgcccgcaagaagggacaaaaattgacggaagaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 508 - DNA, 681 bp, Artificial Sequence
  Description of Artificial Sequence: Synthetic polynucleotide
  modified_base (1)..(213): a, c, t, g, unknown or other
  modified_base (367)..(480): a, c, t, g, unknown or other
  modified_base (679)..(681): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatcaaatatgcaaaaccaagggcgtttgcaatgcttgaaggccagggatgaacatgtgaaaagcgtgttgaatgaggcgcgcggaaatctttcaaaaatttcctccgacaccaatcgatatccgccaattctgaaaggattgatcatgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttttgcaggtcagcattgacaatgagcactatttggcatcggacaatgcaggcggtgtggaattgctggcaaggggaggaaaaatccgtgtctcctccactttggagtctcgtttggatttgattgccgaccaaattgtgcctcaaattcggacagctcttttcggaccaaatccaaaccgcaaattcttcgacnnn

SEQ ID NO: 509 - DNA, 1392 bp, Artificial Sequence
  Description of Artificial Sequence: Synthetic polynucleotide
  modified_base (1)..(12): a, c, t, g, unknown or other
  modified_base (222)..(222): a, c, t, g, unknown or other
  modified_base (228)..(234): a, c, t, g, unknown or other
  modified_base (237)..(237): a, c, t, g, unknown or other
  modified_base (240)..(240): a, c, t, g, unknown or other
  modified_base (246)..(246): a, c, t, g, unknown or other
  modified_base (249)..(256): a, c, t, g, unknown or other
  modified_base (258)..(259): a, c, t, g, unknown or other
  modified_base (261)..(263): a, c, t, g, unknown or other
  modified_base (267)..(268): a, c, t, g, unknown or other
  modified_base (270)..(270): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (285)..(288): a, c, t, g, unknown or other
  modified_base (298)..(300): a, c, t, g, unknown or other
  modified_base (303)..(303): a, c, t, g, unknown or other
  modified_base (312)..(312): a, c, t, g, unknown or other
  modified_base (316)..(316): a, c, t, g, unknown or other
  modified_base (318)..(319): a, c, t, g, unknown or other
  modified_base (321)..(321): a, c, t, g, unknown or other
  modified_base (324)..(324): a, c, t, g, unknown or other
  modified_base (331)..(332): a, c, t, g, unknown or other
  modified_base (336)..(337): a, c, t, g, unknown or other
  modified_base (339)..(339): a, c, t, g, unknown or other
  modified_base (345)..(345): a, c, t, g, unknown or other
  modified_base (349)..(356): a, c, t, g, unknown or other
  modified_base (358)..(360): a, c, t, g, unknown or other
  modified_base (362)..(362): a, c, t, g, unknown or other
  modified_base (372)..(373): a, c, t, g, unknown or other
  modified_base (378)..(379): a, c, t, g, unknown or other
  modified_base (381)..(383): a, c, t, g, unknown or other
  modified_base (385)..(385): a, c, t, g, unknown or other
  modified_base (388)..(389): a, c, t, g, unknown or other
  modified_base (399)..(400): a, c, t, g, unknown or other
  modified_base (402)..(402): a, c, t, g, unknown or other
  modified_base (411)..(412): a, c, t, g, unknown or other
  modified_base (415)..(415): a, c, t, g, unknown or other
  modified_base (417)..(417): a, c, t, g, unknown or other
  modified_base (419)..(419): a, c, t, g, unknown or other
  modified_base (422)..(422): a, c, t, g, unknown or other
  modified_base (424)..(424): a, c, t, g, unknown or other
  modified_base (426)..(427): a, c, t, g, unknown or other
  modified_base (429)..(429): a, c, t, g, unknown or other
  modified_base (433)..(433): a, c, t, g, unknown or other
  modified_base (435)..(435): a, c, t, g, unknown or other
  modified_base (577)..(1197): a, c, t, g, unknown or other
  modified_base (1281)..(1281): a, c, t, g, unknown or other
  modified_base (1339)..(1341): a, c, t, g, unknown or other
  modified_base (1363)..(1392): a, c, t, g, unknown or other
nnnnnnnnnnnnaagatccacatcaatattgttgtgatcggtcacgtcgattccggaaagtcaacaacaaccggacatctgatctacaaatgcggtggaatcgacaagcgaacaattgagaagttcgagaaggaagcgcaggagatgggcaagggttcattcaaatacgcttgggtcttggacaagctgaaggcagaacgtgagcgtggtatcaccatcganattgcnnnnnnnaanttngagacngcnnnnnnnnanntnnncatnntngangcnccnggccannnngatttcatcnnnaanatgatcacnggancnncncangccgatnncgcnntnttggtngtgnnnnnnnntnnngntgaattcgannccggnntnnncnagnntggtcaaacnngngaacatgcnntgntngntcnancnntnggtntnaaacaactcatcgttgcatgcaacaagatggacaccaccgagccgccattctctgaggcccgttatgaggaagtcaagaatgaggtgtcaaacttcatcaagaagattggctacaatccggccaccgtcgcattcgttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcattgtcgatctgattccatccaagccactttgtgttgaggctttcaccgactatgctccattgggacgctttgctgtctgngacatgcgtcaaaccgtggccgtcggtgtcatcaaggccgttgagaaggttgagggcnnnggtggcaaagtgaccaagagcnnnnnnnnnnnnnnnnnnnnnnnnnnnnnn

SEQ ID NO: 510 - DNA, 2055 bp, Artificial Sequence
  Description of Artificial Sequence: Synthetic polynucleotide
  modified_base (1)..(204): a, c, t, g, unknown or other
  modified_base (360)..(360): a, c, t, g, unknown or other
  modified_base (451)..(1095): a, c, t, g, unknown or other
  modified_base (1381)..(1395): a, c, t, g, unknown or other
  modified_base (1539)..(1542): a, c, t, g, unknown or other
  modified_base (1548)..(1548): a, c, t, g, unknown or other
  modified_base (1553)..(1553): a, c, t, g, unknown or other
  modified_base (1557)..(1558): a, c, t, g, unknown or other
  modified_base (1563)..(1564): a, c, t, g, unknown or other
  modified_base (1566)..(1566): a, c, t, g, unknown or other
  modified_base (1570)..(1570): a, c, t, g, unknown or other
  modified_base (1572)..(1572): a, c, t, g, unknown or other
  modified_base (1575)..(1576): a, c, t, g, unknown or other
  modified_base (1578)..(1578): a, c, t, g, unknown or other
  modified_base (1581)..(1582): a, c, t, g, unknown or other
  modified_base (1584)..(1586): a, c, t, g, unknown or other
  modified_base (1590)..(1590): a, c, t, g, unknown or other
  modified_base (1593)..(1594): a, c, t, g, unknown or other
  modified_base (1596)..(1598): a, c, t, g, unknown or other
  modified_base (1603)..(1604): a, c, t, g, unknown or other
  modified_base (1607)..(1607): a, c, t, g, unknown or other
  modified_base (1611)..(1621): a, c, t, g, unknown or other
  modified_base (1623)..(1623): a, c, t, g, unknown or other
  modified_base (1626)..(1626): a, c, t, g, unknown or other
  modified_base (1629)..(1629): a, c, t, g, unknown or other
  modified_base (1632)..(1632): a, c, t, g, unknown or other
  modified_base (1635)..(1636): a, c, t, g, unknown or other
  modified_base (1729)..(2055): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggactcgctgataaagttgtaattgccaaagtcaatgatgaactatgggatttggatagaccattggaggcggatgccaccctaaaattgttgacattcgacgatgatgaaggcaaacaagttttttggcatagctcagcgcacattcttggngaagctgccgaacgctatcgtggagttcatctttgctatggtccaccaattcaagaaggattttattatgatatgttcattgaagggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgtccgatgaactgtcctcaccacatgatggtgtacaaatccaatatgcacagctaccgtgatcttccgatccgtattgccgaactgggtatgatgcatcgctatgaaatgtcaggtgcgttgacaggtctgcaccgtgtacgtgcgatgacactgaatgactctcacatctttgcacgtccggatcagatcaaagaagagtttgctcgtgttatcgaattgatccaaacggtatataaagactttggcattcacgaatatcgtttccgtctatcttaccgtnnnnnnnnnnnnnnnggctcggaagaattgtgggatcaggcggaacaggcgttacgcaatgtgttagacgcccgcggtgtggaatatcgcattaacgaaggcgacggcgccttttacgggccgaagatcgactttcacatacttgatgcgctgaagcgnnnntggcantgcgnaacnntccanntngatntncanntnccnnannnattnganntnnnttatnntgntgannnnnnnnnnngncancgnccngtnntgattcatcgtgcaattttcggctcattggaacgtttcattgcaattttgacggaaaattttgccggaaaatggccattctggctttcacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 511 - DNA, 2349 bp, Artificial Sequence
  Description of Artificial Sequence: Synthetic polynucleotide
  modified_base (1)..(366): a, c, t, g, unknown or other
  modified_base (682)..(1134): a, c, t, g, unknown or other
  modified_base (1189)..(1191): a, c, t, g, unknown or other
  modified_base (1282)..(1458): a, c, t, g, unknown or other
  modified_base (1509)..(1509): a, c, t, g, unknown or other
  modified_base (1655)..(1655): a, c, t, g, unknown or other
  modified_base (1681)..(1683): a, c, t, g, unknown or other
  modified_base (1719)..(1719): a, c, t, g, unknown or other
  modified_base (1723)..(1726): a, c, t, g, unknown or other
  modified_base (1730)..(1730): a, c, t, g, unknown or other
  modified_base (1738)..(1738): a, c, t, g, unknown or other
  modified_base (1740)..(1740): a, c, t, g, unknown or other
  modified_base (1749)..(1749): a, c, t, g, unknown or other
  modified_base (1755)..(1758): a, c, t, g, unknown or other
  modified_base (1760)..(1763): a, c, t, g, unknown or other
  modified_base (1767)..(1767): a, c, t, g, unknown or other
  modified_base (1772)..(1780): a, c, t, g, unknown or other
  modified_base (1791)..(1791): a, c, t, g, unknown or other
  modified_base (1793)..(1798): a, c, t, g, unknown or other
  modified_base (1800)..(1802): a, c, t, g, unknown or other
  modified_base (1804)..(1804): a, c, t, g, unknown or other
  modified_base (1806)..(1810): a, c, t, g, unknown or other
  modified_base (1812)..(1813): a, c, t, g, unknown or other
  modified_base (1815)..(1815): a, c, t, g, unknown or other
  modified_base (1819)..(1819): a, c, t, g, unknown or other
  modified_base (1824)..(1826): a, c, t, g, unknown or other
  modified_base (1828)..(1828): a, c, t, g, unknown or other
  modified_base (1830)..(1838): a, c, t, g, unknown or other
  modified_base (1840)..(1840): a, c, t, g, unknown or other
  modified_base (1842)..(1842): a, c, t, g, unknown or other
  modified_base (1845)..(1845): a, c, t, g, unknown or other
  modified_base (1851)..(1851): a, c, t, g, unknown or other
  modified_base (1860)..(1860): a, c, t, g, unknown or other
  modified_base (1864)..(1864): a, c, t, g, unknown or other
  modified_base (1866)..(1866): a, c, t, g, unknown or other
  modified_base (1869)..(1870): a, c, t, g, unknown or other
  modified_base (1872)..(1872): a, c, t, g, unknown or other
  modified_base (1875)..(1878): a, c, t, g, unknown or other
  modified_base (1882)..(1884): a, c, t, g, unknown or other
  modified_base (1890)..(1890): a, c, t, g, unknown or other
  modified_base (1893)..(1894): a, c, t, g, unknown or other
  modified_base (1896)..(1898): a, c, t, g, unknown or other
  modified_base (1902)..(1903): a, c, t, g, unknown or other
  modified_base (1909)..(1909): a, c, t, g, unknown or other
  modified_base (1911)..(1914): a, c, t, g, unknown or other
  modified_base (1917)..(1920): a, c, t, g, unknown or other
  modified_base (1923)..(1923): a, c, t, g, unknown or other
  modified_base (1925)..(1928): a, c, t, g, unknown or other
  modified_base (1930)..(1934): a, c, t, g, unknown or other
  modified_base (1936)..(1936): a, c, t, g, unknown or other
  modified_base (1939)..(1939): a, c, t, g, unknown or other
  modified_base (1941)..(1942): a, c, t, g, unknown or other
  modified_base (1946)..(1947): a, c, t, g, unknown or other
  modified_base (1950)..(1950): a, c, t, g, unknown or other
  modified_base (1956)..(1956): a, c, t, g, unknown or other
  modified_base (1959)..(1959): a, c, t, g, unknown or other
  modified_base (1963)..(1963): a, c, t, g, unknown or other
  modified_base (1965)..(1965): a, c, t, g, unknown or other
  modified_base (1968)..(1968): a, c, t, g, unknown or other
  modified_base (1996)..(2007): a, c, t, g, unknown or other
  modified_base (2184)..(2184): a, c, t, g, unknown or other
  modified_base (2284)..(2349): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaaaaatttgcgataatcggaggcgttgttcttgttttggccgtcttagggaatcattcaacatataaggagatctcatggaaagaattctacaccgattatttggagaagaacaatgttgaaaaagttgaggtcatcggcaacaaatgggtccgaataattccaaaacaggagtcaatggtttgatacacttattatttcaacattggcagtgtggaaaattttgatcgaagtctcagtgcggcacaacagcatttgggtatggatccggctcatcaaattccagttctttataaatccgaaattgattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattggcacgaaagaaatcgccttgcattctgttcatcgatgaaatcgacgcannnggccgaaaacgtggtggaaaaggttcaattggcggccacaatgaggcagagaacacactcaatcagatgctcgtggaaatggatggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacagaattatccagaaaattggccgcccacacacctggattttctgcngccgacatcgccaatgtttgcaatgaagctgcattgattgccgcacgtgatgcccatgaagaagtgatgaccaaagattttgagaaagccattgaaagaagttttgcgggaatggagaagaagagtcaagttttgcagccggacgngaaaaaaacggttgcttatcatgaannngggcatgcaatcgccggatggttccttgaatttgcngatnnnntacntaaagttncnatcattccncgcggnnnngnnnntggntatgnnnnnnnnntgccaaaagancnnnnnntnnntncnnnnnannanttgntggannnantnnnnnnnnntntnggnggtcgngtggcggangaantnttnntnggnnnnatcnnnaccggngcnnannntganntccaanannnnacnnnnatngnnnntnnnnngnttntnnaatnnggnatgagnganaaantnggncctctctccttcgactctccacaacccnnnnnnnnnnnnttcgacaaaccatattcggaggcaaccgctcaactcattgatcaagaagtgcgcgatatggtcaatgcggcactccgtaggaccagggaattgttaatgtccaaagtggagttgatcgagaaggttgcccttcgacttttggaaaaggaagtgatctcgcgtgatgatatgatcgancttcttggaccacgaccatttgccgaaaaacacacttatgaggaatttgtggccggcaccggcggattggacgaggatatttctcttccaaaaggtctannnnnnnnnnnnnnnnnnnnnnnnnnnnnnnnnnnnnnnnnnnnnnnnnnnnnnnnnnnnnnnnnn

SEQ ID NO: 512 - DNA, 1944 bp, Artificial Sequence
  Description of Artificial Sequence: Synthetic polynucleotide
  modified_base (1)..(453): a, c, t, g, unknown or other
  modified_base (523)..(525): a, c, t, g, unknown or other
  modified_base (622)..(627): a, c, t, g, unknown or other
  modified_base (772)..(774): a, c, t, g, unknown or other
  modified_base (1063)..(1944): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaattggaattgggattcgatgcaaaaagggacagatggaatggctataatccggatgattacaatnnngttatgcaagaatatgaaaaaatggacgaaacgaggaaattgattcgggccgaacaattgaaggaggcgggggaggacgaaacaaagctggatgagnnnnnngaaagggatgaggacatttatgcggaggatgcatccgcccccggccaatctgtggatatggactcaaggacaaggattacagtcagaaatttgcgtatcagagaggatacggcaaaatacctttacaatttggacccgaataccnnntattatgacccaaaaagtcgttcaatgcgcgaaaatccattcaagaatattcccggaaaggaacaagaggcggcccaatttgccggggacaatttcactcgatatacgggcgaagtggccgaagcaaatgatgcgcaagtttttgcttgggcggctcgatccaagggaattgatgtgcattcgctggcagaaccaactcggctggaatcattgaaacgggaatttgagaagcaaaagggggagaagaaatccagtgtccgaaatgaattattggagaaatacggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 513 - DNA, 1299 bp, Artificial Sequence
  Description of Artificial Sequence: Synthetic polynucleotide
  modified_base (1)..(363): a, c, t, g, unknown or other
  modified_base (541)..(549): a, c, t, g, unknown or other
  modified_base (745)..(1173): a, c, t, g, unknown or other
  modified_base (1282)..(1299): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtttaaaaaggaaatgcttggcagcctctacaaatatgcaaaattcctttatgaatgtggcaattatttggcggcatccacctatttggaattttatcgaatcctcattcctcaacatgatccaaattatttaaatgcactttacggaaaattggcatcggaaattttattgcaannnnnnnnncatgcgcgtgacgacctgaacagacttcgtgcctacatcgattcggacccattcgagtcggacattgaattgttgcagcatcgagcttggcttttgcactgggccctttatgtgtatttcaatttcccgaagggacgggacgaggtcatcgatttgttcctcaaccagcaaccatacttgaatgcaattcaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcagccaaaccggtgagcattcacgaacaagtaatggagaacacgaagagaatgacacttcgatcacagcaagtcgcattgcaattggagaagattcgagtcgacnnnnnnnnnnnnnnnnnn

SEQ ID NO: 514 - DNA, 1206 bp, Artificial Sequence
  Description of Artificial Sequence: Synthetic polynucleotide
  modified_base (1)..(21): a, c, t, g, unknown or other
  modified_base (256)..(408): a, c, t, g, unknown or other
  modified_base (1129)..(1206): a, c, t, g, unknown or other
nnnnnnnnnnnnnnnnnnnnngcaccccggcatggttcaatgggtttcaccccaaagaagcgatcgaagcgtcatcgtggaaaagtcaaggccttcccaaaggatgatccctcaaagccgatccatttgactgcattcattggctataaagctggtatgacacatatcgttcgagatgtggacaaaattggctcaaaagtgcacaagaaggaagtggtcgaggcggtcacaatcttggaaacaccaccaatggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaagatgaagagggcaaaaagtcgatccaagctgatttgaataagatcaagaaatattgctcctatgttcgagtgatcgcccatactcagatgaaagtcatgaagcatcgcaacaagaaagctcacattatggaaattcaaatcaacggaggaactgtaccggagaaagtggactgggcccaagagcactttgagaagaccgtctcggtggatgaaatcttcaaccaagatgaaatgatcgattgcattggagtgaccaagggcaaagggttcaagggtgtgaccagtcgttggcataccaaaaagttgccgcggaagacgcacaaaggccttcgcaaggttgcttgtattggtgcatggcatccatcgcgtgtgcaattcactgtggctcgtgccggtcaaaagggatatcaccatcggactgaagtgaacaagaagatctaccgcattggcaaatcctgcttgacaccggaagggaagaagaacggctcaaccgaaaatgacgtgaccgccaagaccatcaatccaatgggtggatttccgcattatggattggtcaatcaggactttgtgatgattcgcggctgttgcattggctccaagaagcgcccaataaccatgcgcaaatcgctgatcaatcaaacaaaacgttttgcctttgagaagatcgacctgaaatggattgacacctcctccaaatttggacatggccgcttcnnnnnnnnnnnnnnnnnnnnnnnnnnnnnnnnnnnnnnnnnnnnnnnnnnnnnnnnnnnnnnnnnnnnnnnnnnnnnn

SEQ ID NO: 515 - DNA, 1692 bp, Artificial Sequence
  Description of Artificial Sequence: Synthetic polynucleotide
  modified_base (1)..(6): a, c, t, g, unknown or other
  modified_base (72)..(72): a, c, t, g, unknown or other
  modified_base (153)..(153): a, c, t, g, unknown or other
  modified_base (167)..(167): a, c, t, g, unknown or other
  modified_base (172)..(172): a, c, t, g, unknown or other
  modified_base (178)..(178): a, c, t, g, unknown or other
  modified_base (183)..(183): a, c, t, g, unknown or other
  modified_base (189)..(189): a, c, t, g, unknown or other
  modified_base (192)..(273): a, c, t, g, unknown or other
  modified_base (415)..(477): a, c, t, g, unknown or other
  modified_base (493)..(493): a, c, t, g, unknown or other
  modified_base (499)..(500): a, c, t, g, unknown or other
  modified_base (509)..(509): a, c, t, g, unknown or other
  modified_base (511)..(511): a, c, t, g, unknown or other
  modified_base (517)..(517): a, c, t, g, unknown or other
  modified_base (521)..(522): a, c, t, g, unknown or other
  modified_base (545)..(545): a, c, t, g, unknown or other
  modified_base (550)..(550): a, c, t, g, unknown or other
  modified_base (552)..(552): a, c, t, g, unknown or other
  modified_base (555)..(555): a, c, t, g, unknown or other
  modified_base (564)..(564): a, c, t, g, unknown or other
  modified_base (576)..(576): a, c, t, g, unknown or other
  modified_base (582)..(582): a, c, t, g, unknown or other
  modified_base (588)..(588): a, c, t, g, unknown or other
  modified_base (617)..(618): a, c, t, g, unknown or other
  modified_base (625)..(625): a, c, t, g, unknown or other
  modified_base (630)..(630): a, c, t, g, unknown or other
  modified_base (639)..(639): a, c, t, g, unknown or other
  modified_base (645)..(646): a, c, t, g, unknown or other
  modified_base (651)..(651): a, c, t, g, unknown or other
  modified_base (660)..(660): a, c, t, g, unknown or other
  modified_base (669)..(670): a, c, t, g, unknown or other
  modified_base (684)..(684): a, c, t, g, unknown or other
  modified_base (690)..(691): a, c, t, g, unknown or other
  modified_base (694)..(695): a, c, t, g, unknown or other
  modified_base (703)..(703): a, c, t, g, unknown or other
  modified_base (705)..(705): a, c, t, g, unknown or other
  modified_base (707)..(708): a, c, t, g, unknown or other
  modified_base (713)..(713): a, c, t, g, unknown or other
  modified_base (725)..(726): a, c, t, g, unknown or other
  modified_base (739)..(740): a, c, t, g, unknown or other
  modified_base (748)..(748): a, c, t, g, unknown or other
  modified_base (756)..(756): a, c, t, g, unknown or other
  modified_base (765)..(765): a, c, t, g, unknown or other
  modified_base (769)..(771): a, c, t, g, unknown or other
  modified_base (774)..(774): a, c, t, g, unknown or other
  modified_base (778)..(778): a, c, t, g, unknown or other
  modified_base (780)..(780): a, c, t, g, unknown or other
  modified_base (852)..(852): a, c, t, g, unknown or other
  modified_base (867)..(867): a, c, t, g, unknown or other
  modified_base (873)..(873): a, c, t, g, unknown or other
  modified_base (882)..(882): a, c, t, g, unknown or other
  modified_base (891)..(891): a, c, t, g, unknown or other
  modified_base (897)..(897): a, c, t, g, unknown or other
  modified_base (903)..(904): a, c, t, g, unknown or other
  modified_base (924)..(926): a, c, t, g, unknown or other
  modified_base (928)..(929): a, c, t, g, unknown or other
  modified_base (932)..(932): a, c, t, g, unknown or other
  modified_base (934)..(935): a, c, t, g, unknown or other
  modified_base (940)..(1527): a, c, t, g, unknown or other
  modified_base (1570)..(1570): a, c, t, g, unknown or other
  modified_base (1576)..(1576): a, c, t, g, unknown or other
  modified_base (1578)..(1580): a, c, t, g, unknown or other
  modified_base (1609)..(1611): a, c, t, g, unknown or other
  modified_base (1617)..(1617): a, c, t, g, unknown or other
  modified_base (1623)..(1623): a, c, t, g, unknown or other
  modified_base (1632)..(1632): a, c, t, g, unknown or other
  modified_base (1638)..(1638): a, c, t, g, unknown or other
  modified_base (1650)..(1650): a, c, t, g, unknown or other
  modified_base (1656)..(1656): a, c, t, g, unknown or other
  modified_base (1659)..(1660): a, c, t, g, unknown or other
  modified_base (1674)..(1674): a, c, t, g, unknown or other
  modified_base (1690)..(1692): a, c, t, g, unknown or other
nnnnnnaaaataaagatcaatgttcgggtcaccacgatggacgcggaattggacttttcgattcaatcaacnacactgggcaaacaattattcgatcaagttgtcaaagccatcaatctgcatgaaatttggtattttggccttcaatatgtngactcggaaggatncactncatggntgaanttgaanaannnnnnnnnnnnnnnnnnnnnnnnnnnnnnnnnnnnnnnnnnnnnnnnnnnnnnnnnnnnnnnnnnnnnnnnnnnnnnnnnngaggaattgatccaggatgttacgctgcgtttgttctatttccaagtgaaggatttgattttgcgcgatgaaatctactgtccggctgattcggcacttctgttggcttcctatgcaatgcaggcaaaatatggcgacttcnnnnnnnnnnnnnnnnnnnnnnnnnnnnnnnnnnnnnnnnnnnnnnnnnnnnnnnnnnnnnnntcgcagttcaaaatgnatatcnncgaatgggnanatcgantganngtttggtgggccgatcatcgggnaatgnancgngagacggcnatgctggaatanttgaanattgcncaggatttggagatgtacggagtcaattnntttgaanttcgnaacaaaaantcgacnnatttntatttgggngtggatgcnnttgggctgaacatntatgannaanntgacaaantnannccaanagtcggcttccnntggtccgaaatcnngaatattncattcaangacaagaanttcnnnatnaaancnctgaaccaccaacaaaataaattcgtcttctattctccgagattgtccgtcaataagcaaattttggcattntgcatgggaaatcangaattntatatgcgncgtcgaaanccggantcaatnnaagttcaacaaatgaaacannngnnaangnngaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttgaccaaggaattggacaatgcccgaaatcagcaatcgntcaccnannntgacattttgcatatggaaaataagcgtnnnggacgngatcgntacaaaacnctgcgncaaattcgttcngggaanacnnaacgccgaattgancaatacgaaaatatgnnn

SEQ ID NO: 516 - DNA, 456 bp, Artificial Sequence
  Description of Artificial Sequence: Synthetic polynucleotide
  modified_base (1)..(18): a, c, t, g, unknown or other
  modified_base (106)..(267): a, c, t, g, unknown or other
  modified_base (430)..(456): a, c, t, g, unknown or other
nnnnnnnnnnnnnnnnnngctgaagctcaagaagtaaaaaagaagagaaccttccgcaagttcgtctatcgcggagtcgatttggaacaattgcttgaaatgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgttctgcccgagatggtcggctgcgttgttggcatccacagtggaaaggcttataaccaggtggaaatccgtgctgagatggtcggctactatttgggcgaattctccatcacctataagcccgtgaagcatggtcgtcctggcattggtgcaacgcacnnnnnnnnnnnnnnnnnnnnnnnnnnn

SEQ ID NO: 517 - DNA, 1968 bp, Artificial Sequence
  Description of Artificial Sequence: Synthetic polynucleotide
  modified_base (1)..(9): a, c, t, g, unknown or other
  modified_base (108)..(108): a, c, t, g, unknown or other
  modified_base (211)..(213): a, c, t, g, unknown or other
  modified_base (280)..(282): a, c, t, g, unknown or other
  modified_base (396)..(396): a, c, t, g, unknown or other
  modified_base (561)..(562): a, c, t, g, unknown or other
  modified_base (616)..(618): a, c, t, g, unknown or other
  modified_base (760)..(1968): a, c, t, g, unknown or other
nnnnnnnnnatggtttcaaatcgggaagaggattcaatgaataaagagccttcaatgagtggacagcaaatcgtcggacttattattccgcctccggatattcgacgnattgttgacaaaactgcactgtttgtggcccggaatggcatcgaatttgagaataaaattcgtgagagggaagcttcaaatatgcgtttcaactttttgagtnnngccgacccgtaccatgcttactacaaaaacaaagtgaaggaatatgaaacgggcgttgcatcggccnnnaaactgccggatgccgtccgtgaacatatccaaaaggcggaatttattcctcgcaatccgccgaaacaatttgaattttgtgcggacccatcgacgattaatgcatttgatgtngatcttattcatttgactgcactttttactgcgcggaatggacgtcaatttttgactcaactaatgaatcgtgaagtgcgaaattttcaatttgattttctgaaaccgcaacattacaaatttttcgtatttcacaaaattggtggaacatatacaaaggttatnnttccgccaaaaaatattgtcgatgaattgcgcaactcaaacagtcatcagaagnnnattttggaggatgttcgctatcgagttggctgggaaaagcatcagcgagcgatgaaagaccgagaggaccaagaagttgaacaggagcgaattgcatacaatcaaattgattggcacgattttgtggtcgttcaaaccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 518 - DNA, 714 bp, Artificial Sequence
  Description of Artificial Sequence: Synthetic polynucleotide
  modified_base (1)..(225): a, c, t, g, unknown or other
  modified_base (339)..(339): a, c, t, g, unknown or other
  modified_base (357)..(357): a, c, t, g, unknown or other
  modified_base (366)..(366): a, c, t, g, unknown or other
  modified_base (399)..(399): a, c, t, g, unknown or other
  modified_base (442)..(447): a, c, t, g, unknown or other
  modified_base (550)..(714): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgacaaattgaaggaaaaattggacgaactcaatcaggacaatgaaacacttcttgacaaatataagagagccctggccgagattgagaatacccgcaaacgaggtgaacgnttagtcgatgaatcgaanagctttgcnatacaaggattttgcaaggatctaattgaggtngccgacattcttaatatagctgtgggaacacttgagaaggaannnnnnatggcgaccaacaattcattaaaaaatgtctatgaaggaatcaatatgacgaacgattcattgttaaaaacatttgcaaaacatggcctcatcaaaatcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 519 - DNA, 951 bp, Artificial Sequence
  Description of Artificial Sequence: Synthetic polynucleotide
  modified_base (232)..(951): a, c, t, g, unknown or other
atgacagaaaaaccgtcaaaaacttcgaatcaccaacgtctgaaggagatgatgtgccatttgacaccagaaaaagccgtggttccctacaatgtttgcttcgacaattcgaataatctttgggtctcttcaaaaggtggactgttcaaattcgactcgaccggctcacgggtgcttcatctcaaaaacgatttccccaagaaaatggctccatattcgcaagtaatctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 520 - DNA, 483 bp, Artificial Sequence
  Description of Artificial Sequence: Synthetic polynucleotide
  modified_base (1)..(36): a, c, t, g, unknown or other
  modified_base (99)..(99): a, c, t, g, unknown or other
  modified_base (259)..(483): a, c, t, g, unknown or other
nnnnnnnnnnnnnnnnnnnnnnnnnnnnnnnnnnnncttaattataagatgaagatcatcgtccaggataaccgcactttcattggctacttcaagccntttgacaaacatatgaacgtcatattggccgattgtgaagagttgcgtcgaatcaaaccaaaagtgggcaagaaaacaactgaagaagagaagcgcattctgggacttgtacttctgcgtggcgacaaaatcatctcaatttcggtggaaggacctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 521 - DNA, 498 bp, Artificial Sequence
  Description of Artificial Sequence: Synthetic polynucleotide
  modified_base (1)..(306): a, c, t, g, unknown or other
  modified_base (402)..(402): a, c, t, g, unknown or other
  modified_base (490)..(498): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttggtcattgagcaaatcatcaacattgctcgacaaatgcgccctcgttcaatggcaaagaagttggagggtactgtcaaggaaattttagcnaccgcacaatcggttggctgcacgattgatgggcaacatccgcatgacattgtggatcaaattcgcaacggagaaattgaaattccannnnnnnnn

SEQ ID NO: 522 - DNA, 1638 bp, Artificial Sequence
  Description of Artificial Sequence: Synthetic polynucleotide
  modified_base (1)..(408): a, c, t, g, unknown or other
  modified_base (697)..(894): a, c, t, g, unknown or other
  modified_base (1035)..(1035): a, c, t, g, unknown or other
  modified_base (1114)..(1131): a, c, t, g, unknown or other
  modified_base (1345)..(1416): a, c, t, g, unknown or other
  modified_base (1636)..(1638): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaggatttgatgtttatcgtgattcgcgatggcactggtttcttgcaaagtgttctcactggtttactctgccaaacttatgatgccctgacgctcaacaccgaaagctctatttgtgtttatggagaggtcaacaaacttcctgagggaaaaaccgcaccgggtggcattgaattggtcgtcgatttttgggagctgattcatacggcaccggctggtggcatcgataatgtgttaaatgtggaggcaaatgtggatgtgaagctggacaatcgccatttggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttggagagttgcctttcctcacttggcgattgttattgtattgctcaatcctaccgggcggaaaagtccaggacacgacggcatttggccgaatattcccatgtggaaggcgaatttgcattcatcacttttgacggnctaatggatcgaattgaggatttggtatgcgacacagtggaaaggacgatggctgatccggaaattcgggaactaattnnnnnnnnnnnnnnnnnntttgtcgcaccaaaacgtcctttcctccgaatgacctatgcggaggcaattgaatggcttcaaaagaacaatgtgcacaatgaggagggaaaaccattccaatttggggaggacatccccgagggaccagaacgccaaatgaccgacactattggacagccaataatgttgaaccgattcccggccggcatcaaatccttctacatgtcccggnnnnnnnnnnnnnnnnnnnnnnnnnnnnnnnnnnnnnnnnnnnnnnnnnnnnnnnnnnnnnnnnnnnnnnnntcgatgaggatttggaaggaagcagaattgctggacgccttcaaccgtgcccaaatcgatccaaaacactactattggtacgtggaccaacgcaaatatggaggctgcccacacggtggtttcggcctcggcctagagcgattcgtgtgctggctggccaatcaacaccacatccgggatgtttgcctctaccctcgatacattggccgatgtgcacctnnn

SEQ ID NO: 523 - DNA, 342 bp, Artificial Sequence
  Description of Artificial Sequence: Synthetic polynucleotide
  modified_base (1)..(9): a, c, t, g, unknown or other
  modified_base (21)..(21): a, c, t, g, unknown or other
  modified_base (33)..(33): a, c, t, g, unknown or other
  modified_base (41)..(42): a, c, t, g, unknown or other
  modified_base (60)..(60): a, c, t, g, unknown or other
  modified_base (64)..(66): a, c, t, g, unknown or other
  modified_base (68)..(68): a, c, t, g, unknown or other
  modified_base (105)..(105): a, c, t, g, unknown or other
  modified_base (111)..(111): a, c, t, g, unknown or other
  modified_base (120)..(120): a, c, t, g, unknown or other
  modified_base (126)..(127): a, c, t, g, unknown or other
  modified_base (136)..(136): a, c, t, g, unknown or other
  modified_base (138)..(139): a, c, t, g, unknown or other
  modified_base (153)..(153): a, c, t, g, unknown or other
  modified_base (159)..(159): a, c, t, g, unknown or other
  modified_base (165)..(165): a, c, t, g, unknown or other
  modified_base (211)..(216): a, c, t, g, unknown or other
  modified_base (258)..(258): a, c, t, g, unknown or other
  modified_base (268)..(268): a, c, t, g, unknown or other
  modified_base (273)..(273): a, c, t, g, unknown or other
  modified_base (291)..(291): a, c, t, g, unknown or other
  modified_base (327)..(327): a, c, t, g, unknown or other
  modified_base (340)..(342): a, c, t, g, unknown or other
nnnnnnnnngaagttttcgangcactttccaanctttacanngattatcaacgaacaacncccnnnanactcaaattgatcgatgcttatatgttctacattttnatgacnggcattatncaattnntttattgcntnntggttggcactttnccattnaatgcntttctggccggtttcatctcttccgttgccagctttgttttggcannnnnncttcgcatccaagtgaatccggaaaacaaatcggaattcccnaatattagcncggancgtgcatttgctgacttnatttttgcacatgttatcctgcatttggtcgtcatnaactttattggcnnn

SEQ ID NO: 524 - DNA, 1617 bp, Artificial Sequence
  Description of Artificial Sequence: Synthetic polynucleotide
  modified_base (1)..(90): a, c, t, g, unknown or other
  modified_base (265)..(609): a, c, t, g, unknown or other
  modified_base (765)..(765): a, c, t, g, unknown or other
  modified_base (1222)..(1617): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatcgagcgcagaagtgtcaagaattctcgaggaaaagattctgggccaggagacgaaaatcaatttggaagaaactggacgcgttctttccattggtgatgggattgcccgcgtttacggactcaaaaacatccaagccgaagaaatggttgaattcgattcaggaatgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcaattgccatcgacacaatcatcaatcaaaaacgtttcaatgccagtgccgaggagaagaagaagctgtattgcatttatgtggccattggtcaaaagcgttccaccgttgcccaaattgtgaaacgtctcacggatgcggatgcgatggantacacaattattgtttcggccaccgcctccgacgctgccccactgcaatttttggccccatattccggcgctgcaatgggcgaatatttccgtgacaatggaaagcatgctttgatcatttacgacgatttgtccaaacatgccgtcgcctaccgccaaatgtcactgctccttcgccgtccgcccggccgtgaagcatatcctggtgatgtcttttatctgcattctcgcttgctggaaagggcagccaaaatgaacgaaacgcacaaaggtggatcaatgaccgcactgcccatcatcgaaacgcaggccggcgatgtctctgcctacattccaacaaatgtcatttccattacggacggccaaattttccttgaaactgaacttttctacaagggagtgcggcccgccatcaatgttggtctctccgtctcccgtgtcggttctgctgcgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 525 - DNA, 2619 bp, Artificial Sequence
  Description of Artificial Sequence: Synthetic polynucleotide
  modified_base (1)..(828): a, c, t, g, unknown or other
  modified_base (940)..(942): a, c, t, g, unknown or other
  modified_base (1036)..(1041): a, c, t, g, unknown or other
  modified_base (1243)..(1326): a, c, t, g, unknown or other
  modified_base (1519)..(2379): a, c, t, g, unknown or other
  modified_base (2428)..(2430): a, c, t, g, unknown or other
  modified_base (2545)..(2619): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacttcaggtctatttgttcgcaatctaccattctcatgttctgaatcaaatttgagtgagctgttctcaccgtttggaccaatcgcagaattagaatgtatcatcaatnnncgagctggagagtgcaaaggatttgctctttgcacttttatgtttccggaacatgcattggaagcatggaaaaagttggatgggaagatttttnnnnnnatggtaaataatttgtttaacattttaaattaaatgttcaaaaaatagggccgaatgcttcatataatagctggggaggagaagaaaaagtcaagcgcgaaccaacaagaaggcaaagccctctccaatttccaacgggacagagaagtgaatcgcaaagaaaacgccggaaaaaccgcccatacttggaatgcactttttnnnnnnnnnnnnnnnnnnnnnnnnnnnnnnnnnnnnnnnnnnnnnnnnnnnnnnnnnnnnnnnnnnnnnnnnnnnnnnnnnnnnagtaccgccgttcgaatggcaatggccgaaacaaatttggtgcgagaaacgaggaaatttttgattgagaatggaattaaattggatgctttttcaaaagcaaatgcgaaaaggtcaaaaactgttattttggtgaagaatttatctggacgacctgaacaagcacaattgaagaaattattttcacaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttgattttatttcaattggcgatgcaaaacgtgcaatggactcgnnngcacattcaacacatttatacgggagaagattggttttggaatgggcaaaacaggaggaaacaattgatgaattgaggaataaaacgaagaggaaaaatgcatccggggaaagannnnnnnnnnnnnnnnnnnnnnnnnnnnnnnnnnnnnnnnnnnnnnnnnnnnnnnnnnnnnnnnnnnnnnnnnnn

SEQ ID NO: 526 - DNA, 1245 bp, Artificial Sequence
  Description of Artificial Sequence: Synthetic polynucleotide
  modified_base (1)..(90): a, c, t, g, unknown or other
  modified_base (312)..(312): a, c, t, g, unknown or other
  modified_base (571)..(768): a, c, t, g, unknown or other
  modified_base (829)..(831): a, c, t, g, unknown or other
  modified_base (901)..(901): a, c, t, g, unknown or other
  modified_base (903)..(903): a, c, t, g, unknown or other
  modified_base (909)..(909): a, c, t, g, unknown or other
  modified_base (1243)..(1245): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtgattgaagacgactatttgaaattaaaaaggctggagaacaaattggcacatttggatgtcatggaggagtatcttaaattggatatgcgcaatctcgagaaggaactcgttcatgcacaggaagaggttaaacgaatccaatctgttccattgatcattggccaattccttgaagcggtggattatgaccacgcaattgttggttccaccacagantcaaattactatgtgaaagttctttccattcttgaccgagaattgctgaagcccggctgcagtgtttctctgcataaatattccaatgccttggtcgatgttcttccaccggaatcggattcgtcaattcaaatgcttcgtcccgatgagaaaccggacatttcctatgccgatgttggaggattggacacacagaaacaagaagttcgcgaggctgtcgaacttccactcaccaatggggagctctatgaacaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattttcattgacgaaatcgacgcaattgccacaaaacgttttgatgcccaaactggannngaccgagaagtgcaacgaattttgctggaattgctcaaccaaatggacgggtttgatcaaagcacaaatntnaaggtnattatggccactaatcgacaggacacgctcgatcccgctttgctccgtcccggccgcctggaccgcaaaattgaattcccaatgccggatcgacgacaaaaacgattggttttctcgacggtgacggccaaaatgaatttgagcgatgaaatcgacctcgaggattatgtctcacgtccggataaaatctcatgtgccgaaatatcctcaatttgccaagaggctggaatgttcgccgtccgtgagaatcgttacatggtcttaaacaaggatttcaacaaggcatataaacaagtcgtcaaaaaggacaatgatgaatttgatttctacaaannn

SEQ ID NO: 527 - DNA, 1410 bp, Artificial Sequence
  Description of Artificial Sequence: Synthetic polynucleotide
  modified_base (1)..(6): a, c, t, g, unknown or other
  modified_base (141)..(141): a, c, t, g, unknown or other
  modified_base (306)..(306): a, c, t, g, unknown or other
  modified_base (399)..(399): a, c, t, g, unknown or other
  modified_base (441)..(441): a, c, t, g, unknown or other
  modified_base (583)..(852): a, c, t, g, unknown or other
  modified_base (1263)..(1263): a, c, t, g, unknown or other
  modified_base (1393)..(1410): a, c, t, g, unknown or other
nnnnnnacaaatgcgaatgaatcggcggctcaagattggttaatgaaacaggatttgtcaaaattggatccaacaaaattgacgcccttaactgaagaggttataagtcgtcaagcaacaatcaatattggaacaattgtncatgtagcgcacggaaaatcaacattggtcaaggctatctccggcgttcacactgtcaaatttaaaaatgagttggagcggaacattaccatcaagctgggatacgcaaatgcaaagatttatcgatgctcgaatccggattgtcctcggccccattgctatcgntccgctggctcaaacacacctgatcgaattccatgcagtcgtgcgggttgtgaaggccaattcgtttgtgttcgtcatattttgcgggttgtntgtccgggccacgacattctaatggcaacaatgttgaacganaattaatttgaggatgccgctttgcttttggtcgccggcaatgaaccttgtccacaaccacaaacttccgaacatttggccgccattgaaatcatgaaattgaagcatatgctaattttacaaaataaaattgatttgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatattgcgtattggccaagaaatcgaggttaggccaggaattgtgaacaaaatgccggatggcaccgttcaatgtcggccaatttattcgcggattgtttccctctttgcggaacaaaatcatttgcaatacgccgtgcctggtggattaatcggtgttggcacacaaattgatccaacattgtgccgtggcgatcgactggtcggccatgttttgggggcggtcggaacattgccaaatgtttacaccgatattgagatttcctatcatttattgcgccgtttactcggagttcgcactgaacaaggcaaaaaaggtgcaaaagtgtcaaaattagccaaggacgaaacattgatggtaaacattggctcactttccaccggaggaaaagtgaaagcagtcaaagtngaagctgcgaaaatttccctgaccgacccaatttgcacggagaataaccaaaacattgcgttgagtcgccgaattgacaaacattggcgcctgattggctggggaacaattcgccgtggaaccgtaattnnnnnnnnnnnnnnnnnn

SEQ ID NO: 528 - DNA, 1089 bp, Artificial Sequence
  Description of Artificial Sequence: Synthetic polynucleotide
  modified_base (1)..(117): a, c, t, g, unknown or other
  modified_base (265)..(432): a, c, t, g, unknown or other
  modified_base (631)..(1089): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggtactgttcaccctctcgttttgttgagcgttgttgaccatttcaatcgcataaataagaataagaaggtcaagcgagttgttggcatacttcttggcagtatgaaattcgacaaatcaattgatatcgccaattcttttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaacgtttcactccaaatccggtgcttgtgatcattcaggcggctcaacatgacatgactctgcccaccgatgcatatgttgaagttcaagaagtccatgatgatggaacaccgccagttaaaacatttgaacatgtggcaagtgatattggtgccgaagaggcagaagaagttggagttgaacatcttttaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 529 - DNA, 1998 bp, Artificial Sequence
  Description of Artificial Sequence: Synthetic polynucleotide
  modified_base (1)..(729): a, c, t, g, unknown or other
  modified_base (880)..(882): a, c, t, g, unknown or other
  modified_base (954)..(954): a, c, t, g, unknown or other
  modified_base (1099)..(1099): a, c, t, g, unknown or other
  modified_base (1101)..(1102): a, c, t, g, unknown or other
  modified_base (1105)..(1105): a, c, t, g, unknown or other
  modified_base (1114)..(1115): a, c, t, g, unknown or other
  modified_base (1117)..(1120): a, c, t, g, unknown or other
  modified_base (1123)..(1124): a, c, t, g, unknown or other
  modified_base (1126)..(1126): a, c, t, g, unknown or other
  modified_base (1128)..(1128): a, c, t, g, unknown or other
  modified_base (1130)..(1131): a, c, t, g, unknown or other
  modified_base (1134)..(1134): a, c, t, g, unknown or other
  modified_base (1136)..(1137): a, c, t, g, unknown or other
  modified_base (1141)..(1141): a, c, t, g, unknown or other
  modified_base (1143)..(1143): a, c, t, g, unknown or other
  modified_base (1145)..(1146): a, c, t, g, unknown or other
  modified_base (1152)..(1152): a, c, t, g, unknown or other
  modified_base (1156)..(1162): a, c, t, g, unknown or other
  modified_base (1164)..(1167): a, c, t, g, unknown or other
  modified_base (1170)..(1170): a, c, t, g, unknown or other
  modified_base (1173)..(1173): a, c, t, g, unknown or other
  modified_base (1180)..(1183): a, c, t, g, unknown or other
  modified_base (1187)..(1189): a, c, t, g, unknown or other
  modified_base (1191)..(1191): a, c, t, g, unknown or other
  modified_base (1194)..(1194): a, c, t, g, unknown or other
  modified_base (1196)..(1200): a, c, t, g, unknown or other
  modified_base (1204)..(1206): a, c, t, g, unknown or other
  modified_base (1212)..(1216): a, c, t, g, unknown or other
  modified_base (1218)..(1219): a, c, t, g, unknown or other
  modified_base (1221)..(1221): a, c, t, g, unknown or other
  modified_base (1224)..(1225): a, c, t, g, unknown or other
  modified_base (1227)..(1227): a, c, t, g, unknown or other
  modified_base (1233)..(1234): a, c, t, g, unknown or other
  modified_base (1236)..(1237): a, c, t, g, unknown or other
  modified_base (1240)..(1242): a, c, t, g, unknown or other
  modified_base (1245)..(1246): a, c, t, g, unknown or other
  modified_base (1248)..(1252): a, c, t, g, unknown or other
  modified_base (1255)..(1257): a, c, t, g, unknown or other
  modified_base (1335)..(1335): a, c, t, g, unknown or other
  modified_base (1465)..(1998): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcagatttggaatcgcccatctcttcagtgtatacaaacattgactggtcacaccggttctgtcctttgccttcaatatgataatcaaatcatcgcaagcggcagcagcgatgccactgtccgaatttgggatgtccaaactggccaannnactgaaaccctcattcatcactgcgaggccgttttacacttgcgttttcaagatggaatgctcgtaacatgntcaaaagatcggtcaattgccgtctgggatatggtttcgccccacgaaattgacattcgccgagtgttagttggacatagagcggccgttaacgtggtcgattttgaccaacgttacatcgtatctgctagtggagatcgaacantnnagntttggaatnncnnnnctnntnantnnatncnnacantnannggtcanaccnnnnnnntnnnntgnctncaatatnnnnatcnnntnatngnnnnnggcnnnagcgannnnncnntncgnntntggganntnnaannnggnnannnnntgnnngttttggaaggtcacgaggagcttgttcgatgcatacgattcgattcaaaacgaatcgtttctggtgcatatgatggnaaaataaaaatatgggatctgcaagctgctttggatcctagaacacctccaaattcactttgcttaaaaacactttctgagcatactggacgcgtttttaggctacaatttgatgagtttcaaattgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 530 - DNA, 1620 bp, Artificial Sequence
  Description of Artificial Sequence: Synthetic polynucleotide
  modified_base (138)..(138): a, c, t, g, unknown or other
  modified_base (322)..(579): a, c, t, g, unknown or other
  modified_base (726)..(726): a, c, t, g, unknown or other
  modified_base (1021)..(1077): a, c, t, g, unknown or other
  modified_base (1227)..(1227): a, c, t, g, unknown or other
  modified_base (1285)..(1311): a, c, t, g, unknown or other
  modified_base (1612)..(1620): a, c, t, g, unknown or other
atggcttcaattgcctgtcttaatcccaaagctgaacttgcccgtcatgctgctgctcttgaaatgaacatcagtggagctagaggccttcaagaagttatgaaaacaaatttgggcccaaaagggacactgaaaatncttgtgtcaggttccggcgacttgaaagtgaccaaggacggcaatgttcttttgcatgaaatgcaaatccaacatcccactgcttcattgattgcaaaagcttgtacagcacaaaatgacgcaaccggggatggcacaacttcgactgtacttttgatcggtgaactgcttaagcaagccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaaatggaacatgaaatggagtcggacaccaaattgattcgcgggcttgtgcttgaccatggaggccgtcatccggatatgccaaaaaatcttgaaaatgcctacattctcagttgcaatgtttcattagaattcgagaaagcngaagtcaattccggccttttctataaaaccgcagccgagcgcgagaatttgctgcaagctgagagggaatatattactcgacgagtgatgaaaattatcgaattgaagaaacaagtttgcgattccgaatcagacgggaaaaaattcaattttgtggtcatcaaccaaaagggaattgatccgccatcactggatttgttcgcccaaaatggaattatggcattaaggcgtgccaaacgtcggaacatggaacgtcttcaattggcatgtggaggcgaggcggtcaattcggtgnnnnnnnnnnnnnnnnnnnnnnnnnnnnnnnnnnnnnnnnnnnnnnnnnnnnnnnnnggcgaagacaaatacacattcatcgagggctgtaaaaaaccaaaatcggtcacacttttgctgaaaggaccaaataaacatacaattggccaaatcaaagatgcaatttatgatggaattcgagccgtgttcaatgtgctcaaagatgcngccgttgttcccggtgcaggcgcattcgaaattgccggctattgcacattgaaaaagnnnnnnnnnnnnnnnnnnnnnnnnnnncaaattgggcgttttggccttgccaatgcacttctcataatcccaaaaacattggccattaacagcggccatgatgcacaagatgtgatcgtcaaattggtggaggcctataatgcaggcaccggcgaaacggccgttggtctggatttggtcagtggcgaggcatcaactcttcagggtatttgggacaatgttcgtgtgaagcaggcatcattggccgcttgccacagcattgccagcaatttgcttgaagtggacgaagtgatgagggccggaatgcgcgatttgaaaggagcccaannnnnnnnn

SEQ ID NO: 531 - DNA, 1908 bp, Artificial Sequence
  Description of Artificial Sequence: Synthetic polynucleotide
  modified_base (1)..(1635): a, c, t, g, unknown or other
  modified_base (1638)..(1638): a, c, t, g, unknown or other
  modified_base (1643)..(1643): a, c, t, g, unknown or other
  modified_base (1689)..(1689): a, c, t, g, unknown or other
  modified_base (1725)..(1725): a, c, t, g, unknown or other
  modified_base (1743)..(1743): a, c, t, g, unknown or other
  modified_base (1746)..(1746): a, c, t, g, unknown or other
  modified_base (1755)..(1755): a, c, t, g, unknown or other
  modified_base (1770)..(1770): a, c, t, g, unknown or other
  modified_base (1864)..(1908): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnccagnaaattacgatccagaaatgccgcctgatccagaaagatggttgccncgccaggaaaggacggcttatcggaagaaaaaaaanttcaaggatcgagaagtnggncgaggaacncaagggaccgccgcntatagctctaaagtccccgccggtagcaccacaacctcaacaccgcatgcatcgccgaaaccaactgctgaaggaccaagacagcagagaccgnnnnnnnnnnnnnnnnnnnnnnnnnnnnnnnnnnnnnnnnnnnnn

SEQ ID NO: 532 - DNA, 1464 bp, Artificial Sequence
  Description of Artificial Sequence: Synthetic polynucleotide
  modified_base (1)..(201): a, c, t, g, unknown or other
  modified_base (547)..(549): a, c, t, g, unknown or other
  modified_base (667)..(792): a, c, t, g, unknown or other
  modified_base (997)..(1002): a, c, t, g, unknown or other
  modified_base (1078)..(1254): a, c, t, g, unknown or other
  modified_base (1447)..(1464): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcagaaaaaagaagcacatggcgattcggacgatttaccggataatttattggcaaattttgctgaaattaaattggacaatttaaagcctttgaacattaatcaaatcaaagcgttgaagaaaaaagttgatgaggaagcagtgcaaacaaagattcgaatggaaaatttggagaaaatgaggaatgagaatttaacaaaaattggaaatttattgcatgaatcagtgccaattagcaacaatgaagatgacaatgcaattgaacgaacatttggggattgcgaagtgaagaagaaatattccatggtcgatttggtggtaatgtgcgatggatttgatgggnnncgggggacgaatgtggccggcggaagaggatattttctcaagggtccattggtctttttggagcaagcattgattggattggcattgcggatgctctcaacaaagaatttcgtgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtattatctgatcccaacagcagaagtacccgtaacgaactaccaccgtgaagagattttgaatgccgatgatctgccgaagcatttcgttgcatatagttcctgttttcgctcagaggctggttcagctggacgggatactcgtggcttgatccgtcagcatcagttcaacaaggtagagttgctcaagctatcttcaccannnnnngagacatcgtatgatgagctggagaaaatgacacaaaacgcagagcgtgtactacaacttctgggattgccttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtaaattatgtgcatatgttgaatgcgacaatgtgcgccaccactcgagtgatttgtgcaattttggagaattatcagactgaagaggccattgaagtgccgaaagcattgcgaccatttatgccacctcaatatgctgaacgaattccttttgtgaaggcagcgccaattgacacagagaaaatgaaannnnnnnnnnnnnnnnnn

SEQ ID NO: 533 - DNA, 1017 bp, Artificial Sequence
  Description of Artificial Sequence: Synthetic polynucleotide
  modified_base (1)..(168): a, c, t, g, unknown or other
  modified_base (171)..(175): a, c, t, g, unknown or other
  modified_base (177)..(177): a, c, t, g, unknown or other
  modified_base (180)..(180): a, c, t, g, unknown or other
  modified_base (184)..(186): a, c, t, g, unknown or other
  modified_base (189)..(192): a, c, t, g, unknown or other
  modified_base (195)..(195): a, c, t, g, unknown or other
  modified_base (198)..(199): a, c, t, g, unknown or other
  modified_base (201)..(201): a, c, t, g, unknown or other
  modified_base (203)..(205): a, c, t, g, unknown or other
  modified_base (207)..(207): a, c, t, g, unknown or other
  modified_base (210)..(210): a, c, t, g, unknown or other
  modified_base (214)..(214): a, c, t, g, unknown or other
  modified_base (216)..(216): a, c, t, g, unknown or other
  modified_base (218)..(218): a, c, t, g, unknown or other
  modified_base (222)..(222): a, c, t, g, unknown or other
  modified_base (226)..(231): a, c, t, g, unknown or other
  modified_base (236)..(238): a, c, t, g, unknown or other
  modified_base (240)..(240): a, c, t, g, unknown or other
  modified_base (243)..(243): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (277)..(278): a, c, t, g, unknown or other
  modified_base (280)..(285): a, c, t, g, unknown or other
  modified_base (288)..(288): a, c, t, g, unknown or other
  modified_base (294)..(294): a, c, t, g, unknown or other
  modified_base (315)..(316): a, c, t, g, unknown or other
  modified_base (318)..(318): a, c, t, g, unknown or other
  modified_base (323)..(325): a, c, t, g, unknown or other
  modified_base (327)..(327): a, c, t, g, unknown or other
  modified_base (339)..(339): a, c, t, g, unknown or other
  modified_base (343)..(343): a, c, t, g, unknown or other
  modified_base (345)..(345): a, c, t, g, unknown or other
  modified_base (351)..(351): a, c, t, g, unknown or other
  modified_base (354)..(354): a, c, t, g, unknown or other
  modified_base (356)..(356): a, c, t, g, unknown or other
  modified_base (363)..(363): a, c, t, g, unknown or other
  modified_base (369)..(372): a, c, t, g, unknown or other
  modified_base (375)..(375): a, c, t, g, unknown or other
  modified_base (379)..(384): a, c, t, g, unknown or other
  modified_base (390)..(396): a, c, t, g, unknown or other
  modified_base (399)..(399): a, c, t, g, unknown or other
  modified_base (406)..(407): a, c, t, g, unknown or other
  modified_base (411)..(411): a, c, t, g, unknown or other
  modified_base (416)..(416): a, c, t, g, unknown or other
  modified_base (420)..(424): a, c, t, g, unknown or other
  modified_base (426)..(426): a, c, t, g, unknown or other
  modified_base (429)..(429): a, c, t, g, unknown or other
  modified_base (456)..(456): a, c, t, g, unknown or other
  modified_base (468)..(468): a, c, t, g, unknown or other
  modified_base (474)..(475): a, c, t, g, unknown or other
  modified_base (477)..(478): a, c, t, g, unknown or other
  modified_base (480)..(480): a, c, t, g, unknown or other
  modified_base (482)..(482): a, c, t, g, unknown or other
  modified_base (484)..(484): a, c, t, g, unknown or other
  modified_base (486)..(486): a, c, t, g, unknown or other
  modified_base (490)..(491): a, c, t, g, unknown or other
  modified_base (495)..(498): a, c, t, g, unknown or other
  modified_base (501)..(501): a, c, t, g, unknown or other
  modified_base (503)..(504): a, c, t, g, unknown or other
  modified_base (507)..(507): a, c, t, g, unknown or other
  modified_base (522)..(522): a, c, t, g, unknown or other
  modified_base (526)..(526): a, c, t, g, unknown or other
  modified_base (528)..(528): a, c, t, g, unknown or other
  modified_base (531)..(531): a, c, t, g, unknown or other
  modified_base (540)..(540): a, c, t, g, unknown or other
  modified_base (547)..(547): a, c, t, g, unknown or other
  modified_base (550)..(555): a, c, t, g, unknown or other
  modified_base (557)..(558): a, c, t, g, unknown or other
  modified_base (561)..(562): a, c, t, g, unknown or other
  modified_base (564)..(564): a, c, t, g, unknown or other
  modified_base (567)..(568): a, c, t, g, unknown or other
  modified_base (570)..(571): a, c, t, g, unknown or other
  modified_base (580)..(580): a, c, t, g, unknown or other
  modified_base (582)..(583): a, c, t, g, unknown or other
  modified_base (585)..(585): a, c, t, g, unknown or other
  modified_base (588)..(588): a, c, t, g, unknown or other
  modified_base (590)..(590): a, c, t, g, unknown or other
  modified_base (596)..(596): a, c, t, g, unknown or other
  modified_base (602)..(603): a, c, t, g, unknown or other
  modified_base (607)..(608): a, c, t, g, unknown or other
  modified_base (610)..(610): a, c, t, g, unknown or other
  modified_base (613)..(614): a, c, t, g, unknown or other
  modified_base (617)..(617): a, c, t, g, unknown or other
  modified_base (620)..(621): a, c, t, g, unknown or other
  modified_base (623)..(623): a, c, t, g, unknown or other
  modified_base (625)..(625): a, c, t, g, unknown or other
  modified_base (627)..(628): a, c, t, g, unknown or other
  modified_base (630)..(630): a, c, t, g, unknown or other
  modified_base (632)..(632): a, c, t, g, unknown or other
  modified_base (636)..(636): a, c, t, g, unknown or other
  modified_base (638)..(638): a, c, t, g, unknown or other
  modified_base (642)..(642): a, c, t, g, unknown or other
  modified_base (645)..(645): a, c, t, g, unknown or other
  modified_base (647)..(648): a, c, t, g, unknown or other
  modified_base (651)..(652): a, c, t, g, unknown or other
  modified_base (660)..(662): a, c, t, g, unknown or other
  modified_base (669)..(669): a, c, t, g, unknown or other
  modified_base (671)..(672): a, c, t, g, unknown or other
  modified_base (674)..(676): a, c, t, g, unknown or other
  modified_base (678)..(678): a, c, t, g, unknown or other
  modified_base (683)..(685): a, c, t, g, unknown or other
  modified_base (687)..(687): a, c, t, g, unknown or other
  modified_base (690)..(693): a, c, t, g, unknown or other
  modified_base (697)..(697): a, c, t, g, unknown or other
  modified_base (706)..(709): a, c, t, g, unknown or other
  modified_base (711)..(714): a, c, t, g, unknown or other
  modified_base (716)..(717): a, c, t, g, unknown or other
  modified_base (722)..(724): a, c, t, g, unknown or other
  modified_base (733)..(733): a, c, t, g, unknown or other
  modified_base (736)..(737): a, c, t, g, unknown or other
  modified_base (741)..(741): a, c, t, g, unknown or other
  modified_base (746)..(747): a, c, t, g, unknown or other
  modified_base (750)..(753): a, c, t, g, unknown or other
  modified_base (756)..(756): a, c, t, g, unknown or other
  modified_base (759)..(763): a, c, t, g, unknown or other
  modified_base (768)..(769): a, c, t, g, unknown or other
  modified_base (777)..(777): a, c, t, g, unknown or other
  modified_base (783)..(783): a, c, t, g, unknown or other
  modified_base (786)..(786): a, c, t, g, unknown or other
  modified_base (793)..(793): a, c, t, g, unknown or other
  modified_base (797)..(797): a, c, t, g, unknown or other
  modified_base (802)..(802): a, c, t, g, unknown or other
  modified_base (814)..(814): a, c, t, g, unknown or other
  modified_base (819)..(819): a, c, t, g, unknown or other
  modified_base (874)..(1017): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntannnnncngtngaannnggnnnnctntanncncnnnantancgantntncatnaaannnnnngatgnnntnatntcnccntggcangatattccnctntatgcngatnnannnnnnaangtgttnaatatggtcgtggaaattccnngntggannnangcaaaaatgganatgncnaccaangancnaatgtcnccaatnnnncangatnnnnnnaaaggnnnnnnncgntttgtgnncaanatttncccnnnnnanggntacatttggaattatggggcattgccncaaacttgggangacccnnannangngnanaaanncacnnnngcnannggngacaatgacccaatngatntngtngaaattggntcaaaanttnnnnnnannggnncngtnntnnaagtgaaantnntnggnanattggnactttnntgannangannaancgnntngnanntngntggnantgangtnanngannaattggcnnnaaaattnannannntngaggnnntngannnngaantgcccggannnntnnnngnnacacnnnaatggtttngannttanaaaannccnnnnggnaannnnncaaannaattcgcnttcaanggngaattcnaggnccgtnaatttgcgcatnaagtnatcgacgaaacaaatgcattttggaaggcactcatttccaagcaagatccaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 534 - DNA, 774 bp, Artificial Sequence
  Description of Artificial Sequence: Synthetic polynucleotide
  modified_base (1)..(54): a, c, t, g, unknown or other
  modified_base (162)..(162): a, c, t, g, unknown or other
  modified_base (523)..(774): a, c, t, g, unknown or other
nnnnnnnnnnnnnnnnnnnnnnnnnnnnnnnnnnnnnnnnnnnnnnnnnnnnnngccgttgatccattcacgcgcaaagaatggtacgacatcaaggcgccggcaatgttccaagagcgaaatgttggcaaaactttggtgaaccgaactcaaggaacagcnatctccagtgactttctcaaaggacgagtttatgaggtttctctgggtgatttgaacaattcggacgcggattaccgaaaattccgtctgatctgcgaagaggtgcaagggaaaagttgcctgaccaatttccatggaatgaccttcaccagggacaaactttgttcgattgtcaagaaatggcataccctgattgaggcaaatgttgcggtgaaaaccacggatggttatttgcttcgcctcttctgcattggattcaccaagcgatcaccaaatcaaaccaagaagaccagctatgcgaagacgtctcaagtgcgccaaattcgtgcacggatggtggaaattatgcaaaaggaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 535 - DNA, 3447 bp, Artificial Sequence
  Description of Artificial Sequence: Synthetic polynucleotide
  modified_base (1)..(1812): a, c, t, g, unknown or other
  modified_base (2007)..(2007): a, c, t, g, unknown or other
  modified_base (2107)..(2232): a, c, t, g, unknown or other
  modified_base (2338)..(2340): a, c, t, g, unknown or other
  modified_base (2530)..(2859): a, c, t, g, unknown or other
  modified_base (2968)..(3447): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgcaacaaatgtggccgaaacttccctgaccattcccaacattacttatgtggttgactcagggaaggaaaaacgacgggaatatgatccaataacaggtgtttctcgttttgttgtcgattggtgttcaaaggcgtcagcaaatcagagatcgggacgagccggccgtgtgaagccaggaaatgcttacagnctgtattcttcagctgtttttgaggatatgcaaacgcattcatccccagagattttaaataaacccattgaacagttggttctcttcctaaaatcaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaaataacccctctcggctgcaccctcgtccaaattccattggctccatcatttgcaaaagtgttggtttccgcattcaaagatggccttcttccctatgctnnnctcttggtttcggccctctccgttcgcgaaccgctgattccaatttcggcaattaaagagaaaacgatggaagaaacaaaagcaaaaatgatcgaaataattaaacaacgacaactttggagttcaatcggggaagcgaaattatttggtgatttgaccgtcattttacatttgattggtgcggccgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacccgaatatattctctatcaagaaattattcaaatggaaggaaagaagattatgcagaatttatgtgttgttgatccggaatggataccaaattttgttcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 536 - DNA, 1122 bp, Artificial Sequence
  Description of Artificial Sequence: Synthetic polynucleotide
  modified_base (1)..(117): a, c, t, g, unknown or other
  modified_base (436)..(771): a, c, t, g, unknown or other
  modified_base (988)..(1122): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccggatgacactgttcaagcaaaaaaattcaatccaatggtggctggcgcaccattgttggccgccggctcatgggacaatacttgccgaatttggcaagtcagcgaaaccggccaaactgaaccgaaagcaatacaaaatgtgggcgccccaatactgggattggattggaccgaggatagcacgaaaatattcctggcatgcgccgacaagcaggcccggctttgggatttgaattcaaatcagctggccgttgtgggacaacatgatgagccaattcgaagttgccattggattacatcgccaaattatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagacaatttcacattcaaatgccatcgaactggggaattggtcaacggataccaggaaatatacacagtgaatgatgtcgcattccatccaatccatcaaacgctgtgcaccgttggctcggatgggaaatattcattttgggacaaagatgcgcgcacaaaactgaaagggtccgatgcggtggcaatgccaatcacaaaatgccacattcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 537 - DNA, 1260 bp, Artificial Sequence
  Description of Artificial Sequence: Synthetic polynucleotide
  modified_base (1)..(81): a, c, t, g, unknown or other
  modified_base (103)..(105): a, c, t, g, unknown or other
  modified_base (196)..(360): a, c, t, g, unknown or other
  modified_base (505)..(1260): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnttcatggacgaattagcggccnnnaagagtgccaaaaacaaaaggaaaaaaccatttgattttggggaatggtgccgcgaaattgataatcatccggcattcatgaaggaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatccgacttaattgtcccgatattcaattgaattccattctctatgcgaatcgagcagcggcaaacaaacatttgggcaatttacgatcggctgtgcgagattgcaccagtgccagacgattattgcccgataattttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 538 - DNA, 1461 bp, Artificial Sequence
  Description of Artificial Sequence: Synthetic polynucleotide
  modified_base (103)..(252): a, c, t, g, unknown or other
  modified_base (361)..(363): a, c, t, g, unknown or other
  modified_base (585)..(585): a, c, t, g, unknown or other
  modified_base (679)..(1020): a, c, t, g, unknown or other
  modified_base (1111)..(1116): a, c, t, g, unknown or other
  modified_base (1198)..(1461): a, c, t, g, unknown or other
gtttccgaggctcccaattatctgctatatgaacatgctgttggctacacattactgaaagtgcaagagttcgaggacattggccagattgttcccgaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgccaaagaagaagaagaaagtgcttttgggcgttggggacaagaatttggcctcctcaatcgttgagagcatccccggccttcgtgccacattcctcggtgtannncaggaaattttgcgcggtgtccgttcgcattttcatttgttggcccgcgatttaccgcatgcctcacttcacaaggcccaactttcgctgggacacacctattcacgttcaaaggtgaaattcgatgtccatcgagtggacaatatggtcatccaagcaattgcacttttggaccaattggacaaggacatcaatttgtttgggatgcgaatcaaagaaggntacgcctatcatttcccggaattgatcaaaattgtgcccgacctctacaactacacccgctgcacaaccgcaataatgaatcgagcgaatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttaaatcatttttttattcagcgaatactccaaaatatggcctcctctttcattcaagtttcattggtcgagccgcctccaagcacnnnnnncgaattagccgttttctggccaataaatgtgcaattgcctctcgaattgatagtttttcggacactcccgtttgcacatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 539 - DNA, 543 bp, Artificial Sequence
  Description of Artificial Sequence: Synthetic polynucleotide
  modified_base (1)..(93): a, c, t, g, unknown or other
  modified_base (210)..(210): a, c, t, g, unknown or other
  modified_base (454)..(543): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcaacgaaaaatcggccaatgttctatgaaaagcataaatggccaggcagaaacagagaatttccggagctttcaccaaaatttcaacaaaataatcgaccagaattgagagantacacgggcgtacaaaatgttggcttcatagatcaagagactgggaaatttgtgggagttccggagatggcgcaggaaattgttgttcctgacctttcaaattgttcactgaaaccatatgtttcatacaggactgatgtggagattagaaaaaggtacgaattttattcgaaatatatttattttatatccaatttttagagagctaaaatatgaacaattgttggtcaaacatggcagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 540 - DNA, 705 bp, Artificial Sequence
  Description of Artificial Sequence: Synthetic polynucleotide
  modified_base (1)..(339): a, c, t, g, unknown or other
  modified_base (540)..(540): a, c, t, g, unknown or other
  modified_base (703)..(705): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaggttatgaagcaatgtcccttcggcaatatgaacgattgacgaatggattaaaacctgacttggaatcataccaaaagatgaaggaagttgtgggcgaagagcaattttatccgactgcaaatactctaatccatggatcgcattatccaaccaacaaagaattggatcgactctcggagatgtccaaaaccagnatgaagaaacgtgatgaatatcatcgccgccgaatgttcgatccggacgctccaattgacttcataaatgaacgaaaccgaaaattcaaccacaaactggaacgatattatggaaaattcacggcggatttgaaggaggatttggaacgtggaacagcaattnnn

SEQ ID NO: 541 - DNA, 543 bp, Artificial Sequence
  Description of Artificial Sequence: Synthetic polynucleotide
  modified_base (1)..(129): a, c, t, g, unknown or other
  modified_base (538)..(543): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtctcgtttctggtacttcaccagcatgttgcgtcgtgtgaagaagacccatggagaaattgtttcatgccaagagggttttcgagaagaagcctggctcgtgaagaactatggcatttggctgcgctacgactcacgaactggccaccacaacatgtaccgtgaataccgcgatgtgagcatggccggcgctgtcactcaagcctaccgggacatgggcgcccgccatcgtgcccaagccgaccgaatccaaatcatcaaagtgcaaccaatcaaagtggaggattgcaagcgcaccggagtgaaacaattccaagactccaagatcaaattcccgctgccacatcgcgtctccaaacgccgaaagatgaccccgttcaccactcaacgtccaaagactcatttcnnnnnn

SEQ ID NO: 542 - DNA, 597 bp, Artificial Sequence
  Description of Artificial Sequence: Synthetic polynucleotide
  modified_base (178)..(597): a, c, t, g, unknown or other
atgagcaatcttcgactgcagaaacgattggcctcagccgtcttgaaatgcggaaagggcaaaatctggcttgatccaaatgaagtcaacgaaatttccaatgcaaattcacgtcaaaacattcgccgtttggtcaaggatgggttgatcattcgcaaaccgggcaaagttcattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 543 - DNA, 1950 bp, Artificial Sequence
  Description of Artificial Sequence: Synthetic polynucleotide
  modified_base (1)..(501): a, c, t, g, unknown or other
  modified_base (547)..(552): a, c, t, g, unknown or other
  modified_base (811)..(1950): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcttctctgcgatgatggtcaaatcagaattgcggacttcggcnnnnnntggtcagtgcatgcggtcaatcgacgcaaaacaatgtgcgggacattggactatttgccgcccgaaatggtcaccaaagcgcaccatgatgagagtgttgattattggtcggttggtgtattgtgctatgaatttctggtcggcaaaccgccattcgaaacaaaaacgcaacaagaaacataccagaagataatgaaagtccaataccatttcccgtcatttatgagccaaggcgccagggatttgatctcaaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 544 - DNA, 1842 bp, Artificial Sequence
  Description of Artificial Sequence: Synthetic polynucleotide
  modified_base (1)..(1092): a, c, t, g, unknown or other
  modified_base (1207)..(1842): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgccaacggtagattttgttgagaagaaacaacgcgaattgcaggatgcactcaactacaaatacacggatgccgagatcagcgttatggtcaaggagaagcagcgattcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 545 - DNA, 888 bp, Artificial Sequence
  Description of Artificial Sequence: Synthetic polynucleotide
  modified_base (1)..(396): a, c, t, g, unknown or other
  modified_base (681)..(681): a, c, t, g, unknown or other
  modified_base (847)..(888): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttaaagtgtaaagaaaaatgcatgacggaataccaaaaatcagcagattactacaagggcgaggagcagcgcagttcggctgccaaatgtttgattaaagttgccacattggctgccgaattggaacagtatcaacgttcgatgcacacatttgaggaagtggcaatttatgagactgaaaaccaaatgttgaaatattcggcgaagactcattttttccaagtaattattcgatattcgataaattcattaatttattttaaggctctcctttcatcattntcagagttatgtccacaattctcggaatctcgcgaatgcaaattgattcaggatttgatgcatgcgatggagattggcgacccggatggattcacggacgcaacgcaacaatatgacaaaattagccgtctcgataattggcatgtgcaaatgctggtcaaggtgnnnnnnnnnnnnnnnnnnnnnnnnnnnnnnnnnnnnnnnnnn

SEQ ID NO: 546 - DNA, 2079 bp, Artificial Sequence
  Description of Artificial Sequence: Synthetic polynucleotide
  modified_base (1)..(702): a, c, t, g, unknown or other
  modified_base (850)..(850): a, c, t, g, unknown or other
  modified_base (858)..(859): a, c, t, g, unknown or other
  modified_base (861)..(861): a, c, t, g, unknown or other
  modified_base (867)..(867): a, c, t, g, unknown or other
  modified_base (885)..(885): a, c, t, g, unknown or other
  modified_base (891)..(891): a, c, t, g, unknown or other
  modified_base (900)..(900): a, c, t, g, unknown or other
  modified_base (905)..(906): a, c, t, g, unknown or other
  modified_base (908)..(908): a, c, t, g, unknown or other
  modified_base (912)..(912): a, c, t, g, unknown or other
  modified_base (914)..(915): a, c, t, g, unknown or other
  modified_base (918)..(920): a, c, t, g, unknown or other
  modified_base (922)..(922): a, c, t, g, unknown or other
  modified_base (924)..(924): a, c, t, g, unknown or other
  modified_base (927)..(927): a, c, t, g, unknown or other
  modified_base (932)..(932): a, c, t, g, unknown or other
  modified_base (942)..(942): a, c, t, g, unknown or other
  modified_base (945)..(945): a, c, t, g, unknown or other
  modified_base (948)..(952): a, c, t, g, unknown or other
  modified_base (954)..(954): a, c, t, g, unknown or other
  modified_base (960)..(961): a, c, t, g, unknown or other
  modified_base (963)..(963): a, c, t, g, unknown or other
  modified_base (967)..(969): a, c, t, g, unknown or other
  modified_base (971)..(971): a, c, t, g, unknown or other
  modified_base (975)..(975): a, c, t, g, unknown or other
  modified_base (978)..(978): a, c, t, g, unknown or other
  modified_base (980)..(984): a, c, t, g, unknown or other
  modified_base (986)..(986): a, c, t, g, unknown or other
  modified_base (989)..(989): a, c, t, g, unknown or other
  modified_base (992)..(997): a, c, t, g, unknown or other
  modified_base (999)..(1000): a, c, t, g, unknown or other
  modified_base (1002)..(1003): a, c, t, g, unknown or other
  modified_base (1005)..(1007): a, c, t, g, unknown or other
  modified_base (1009)..(1010): a, c, t, g, unknown or other
  modified_base (1014)..(1017): a, c, t, g, unknown or other
  modified_base (1019)..(1020): a, c, t, g, unknown or other
  modified_base (1023)..(1024): a, c, t, g, unknown or other
  modified_base (1026)..(1027): a, c, t, g, unknown or other
  modified_base (1029)..(1030): a, c, t, g, unknown or other
  modified_base (1065)..(1065): a, c, t, g, unknown or other
  modified_base (1108)..(1119): a, c, t, g, unknown or other
  modified_base (1198)..(1203): a, c, t, g, unknown or other
  modified_base (1410)..(1411): a, c, t, g, unknown or other
  modified_base (1483)..(1483): a, c, t, g, unknown or other
  modified_base (1489)..(1489): a, c, t, g, unknown or other
  modified_base (1491)..(1495): a, c, t, g, unknown or other
  modified_base (1497)..(1504): a, c, t, g, unknown or other
  modified_base (1508)..(1508): a, c, t, g, unknown or other
  modified_base (1608)..(1608): a, c, t, g, unknown or other
  modified_base (1611)..(1611): a, c, t, g, unknown or other
  modified_base (1613)..(1614): a, c, t, g, unknown or other
  modified_base (1620)..(1622): a, c, t, g, unknown or other
  modified_base (1624)..(1624): a, c, t, g, unknown or other
  modified_base (1626)..(1626): a, c, t, g, unknown or other
  modified_base (1628)..(1629): a, c, t, g, unknown or other
  modified_base (1638)..(1638): a, c, t, g, unknown or other
  modified_base (1641)..(1641): a, c, t, g, unknown or other
  modified_base (1644)..(1644): a, c, t, g, unknown or other
  modified_base (1647)..(1648): a, c, t, g, unknown or other
  modified_base (1651)..(1651): a, c, t, g, unknown or other
  modified_base (1653)..(1653): a, c, t, g, unknown or other
  modified_base (1659)..(1659): a, c, t, g, unknown or other
  modified_base (1662)..(1662): a, c, t, g, unknown or other
  modified_base (1665)..(1666): a, c, t, g, unknown or other
  modified_base (1671)..(1671): a, c, t, g, unknown or other
  modified_base (1674)..(1674): a, c, t, g, unknown or other
  modified_base (1678)..(1678): a, c, t, g, unknown or other
  modified_base (1686)..(1687): a, c, t, g, unknown or other
  modified_base (1689)..(1689): a, c, t, g, unknown or other
  modified_base (1695)..(1695): a, c, t, g, unknown or other
  modified_base (1698)..(1698): a, c, t, g, unknown or other
  modified_base (1701)..(1702): a, c, t, g, unknown or other
  modified_base (1713)..(1713): a, c, t, g, unknown or other
  modified_base (1716)..(1716): a, c, t, g, unknown or other
  modified_base (1719)..(1719): a, c, t, g, unknown or other
  modified_base (1725)..(1725): a, c, t, g, unknown or other
  modified_base (1728)..(1728): a, c, t, g, unknown or other
  modified_base (1738)..(1855): a, c, t, g, unknown or other
  modified_base (1857)..(1857): a, c, t, g, unknown or other
  modified_base (1861)..(1861): a, c, t, g, unknown or other
  modified_base (1863)..(1863): a, c, t, g, unknown or other
  modified_base (1866)..(1866): a, c, t, g, unknown or other
  modified_base (1872)..(1872): a, c, t, g, unknown or other
  modified_base (1884)..(1885): a, c, t, g, unknown or other
  modified_base (1888)..(1890): a, c, t, g, unknown or other
  modified_base (1896)..(1896): a, c, t, g, unknown or other
  modified_base (1899)..(1900): a, c, t, g, unknown or other
  modified_base (1902)..(1902): a, c, t, g, unknown or other
  modified_base (1908)..(1908): a, c, t, g, unknown or other
  modified_base (1911)..(1911): a, c, t, g, unknown or other
  modified_base (1917)..(1918): a, c, t, g, unknown or other
  modified_base (1920)..(1920): a, c, t, g, unknown or other
  modified_base (1923)..(1924): a, c, t, g, unknown or other
  modified_base (1926)..(1928): a, c, t, g, unknown or other
  modified_base (1932)..(1932): a, c, t, g, unknown or other
  modified_base (1935)..(1935): a, c, t, g, unknown or other
  modified_base (1938)..(1939): a, c, t, g, unknown or other
  modified_base (1941)..(1941): a, c, t, g, unknown or other
  modified_base (1945)..(1945): a, c, t, g, unknown or other
  modified_base (1947)..(1947): a, c, t, g, unknown or other
  modified_base (1954)..(1955): a, c, t, g, unknown or other
  modified_base (1962)..(1962): a, c, t, g, unknown or other
  modified_base (1965)..(1965): a, c, t, g, unknown or other
  modified_base (1968)..(1968): a, c, t, g, unknown or other
  modified_base (1971)..(1971): a, c, t, g, unknown or other
  modified_base (1978)..(1978): a, c, t, g, unknown or other
  modified_base (1984)..(1984): a, c, t, g, unknown or other
  modified_base (1986)..(1986): a, c, t, g, unknown or other
  modified_base (1992)..(1992): a, c, t, g, unknown or other
  modified_base (1995)..(1995): a, c, t, g, unknown or other
  modified_base (1998)..(1998): a, c, t, g, unknown or other
  modified_base (2004)..(2004): a, c, t, g, unknown or other
  modified_base (2007)..(2007): a, c, t, g, unknown or other
  modified_base (2011)..(2011): a, c, t, g, unknown or other
  modified_base (2013)..(2013): a, c, t, g, unknown or other
  modified_base (2016)..(2016): a, c, t, g, unknown or other
  modified_base (2019)..(2019): a, c, t, g, unknown or other
  modified_base (2038)..(2079): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttaacgatcccaaaaatatcaaaacggaatgttttggtggattattcggcgccgaatattgcaaaacaaatgcatgttggacatttacgctcgacaattattggcgaatccatttcaagactgctcgaatttgttgggttttcgnttcttcgnntnaatcanattggcgattggggcacncaattnggaatgttnattgnntntttncnngannnantnccnaattntttgaatganccnccnnnnntngagganntncaannntnttanaangnnnnnanaanaannnnnnannannannntnnattnnnnannagnncnnannaatgcgttgtgaaattgcaaaattttgatttaganattgtgaaagcatggcaaatgatttgtgatattagccgaaaannnnnnnnnnnnatttatgaaaaattggacatcaaattgattgaacgcggcgaatcattttatcaatcgaggatgaaggaaattgtgaaannnnnngaattggaagaaggaggccatttggtagaggaagatggtcgaaagctgttcttcccaccggattgtgccattccattgacggtggtgaaaagtgatggcggatttacctatgataccagcgatttggccgcaataaagcagagaatttttgaggaaaaagccgattggatactttatgtcgtggacaaaggacaatccgtacatttnnagactgtattcgctgccggacgtcaattgggctggtacgatcctaacgagaaatgcattgagcatgttcaanttggantnnnnntnnnnnnnnacangaaaaagtttaaaactcgttcgggagacactgtaaaattggaagatttgatgaatgagggtgtccgacggtctgaagagaaattacggatgaaaacaaangananngaattnnngnangnngaattgacnaangcngcnnaancnttggcntanggnngcatnaantatncggatttnncncaatcncgnatnngcgattatgtnttntcntttgancgngtaagtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnccantngancatccnaaagagattcgnntgnnnaaacanatnntnaaattntcngattgnntnctnnannngctnganacnntncaantnaacaaannatgcgantanatntangaattgnccacantnttcagnganttntacaangantgcnangtngtngtgcgcaaattggatggannnnnnnnnnnnnnnnnnnnnnnnnnnnnnnnnnnnnnnnnn

SEQ ID NO: 547 - DNA, 753 bp, Artificial Sequence
  Description of Artificial Sequence: Synthetic polynucleotide
  modified_base (1)..(369): a, c, t, g, unknown or other
  modified_base (477)..(477): a, c, t, g, unknown or other
  modified_base (557)..(557): a, c, t, g, unknown or other
  modified_base (559)..(561): a, c, t, g, unknown or other
  modified_base (709)..(753): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggcagcaagaaaaccgcattcacaaattttgccgagatttgccgcctattgaagcgtgaacccaaacatgtgctccaatatttgatggccgaattgggaacatcnggttcaattgatggcaaccaatgtctgattgtgaagggacgtttccagcagaagcattttgagaatgtgcttcgaaaatntnnngaggaatacgtgacttgtcatacatgccgctcttcggacactgaattgaccaaggactctcgcctcttcttcatccaatgcaaagcatgcggaagtcgttgttccgtttccagcatcaaatccggcttcacagcaatgattgggaagnnnnnnnnnnnnnnnnnnnnnnnnnnnnnnnnnnnnnnnnnnnnn

SEQ ID NO: 548 - DNA, 1056 bp, Artificial Sequence
  Description of Artificial Sequence: Synthetic polynucleotide
  modified_base (1)..(66): a, c, t, g, unknown or other
  modified_base (178)..(618): a, c, t, g, unknown or other
  modified_base (789)..(789): a, c, t, g, unknown or other
  modified_base (813)..(813): a, c, t, g, unknown or other
  modified_base (1033)..(1056): a, c, t, g, unknown or other
nnnnnnnnnnnnnnnnnnnnnnnnnnnnnnnnnnnnnnnnnnnnnnnnnnnnnnnnnnnnnnnnnnattgcaaaaatgtcgcaagcggatgcaggacgaataattcatttgggaaaacaaagagaaagggcaaaagaagatattgaaaagcaaagacaaaaattggaaaatgaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcaagtggcattttgctattgggatgggtcgagccatcggaaggatttgaaggtgaaaaagggagcaacaattgcccaattcctgcaaagggcattggagatattccgaagagaattcctcgaattgaaattggcaaccgttgaaagtttgatgttcatcaaagaaatnttgatcattcctcatttttacacnttccaagatttcataaaaacgaggcaaatgggaaaaactgggcctttatggcaatttgattcggtgggggaaatccgagttaggcaagatgcggcattggacattggggaaagtcatccagtcaaggttgttctccgaagttggtatgaaaagaacaagcacatttatccatcctcacgttgggaaccatttgtgcccggcaaaacatacaaaaaaaacnnnnnnnnnnnnnnnnnnnnnnnn

SEQ ID NO: 549 - DNA, 3003 bp, Artificial Sequence
  Description of Artificial Sequence: Synthetic polynucleotide
  modified_base (67)..(69): a, c, t, g, unknown or other
  modified_base (204)..(204): a, c, t, g, unknown or other
  modified_base (218)..(219): a, c, t, g, unknown or other
  modified_base (222)..(222): a, c, t, g, unknown or other
  modified_base (234)..(234): a, c, t, g, unknown or other
  modified_base (241)..(241): a, c, t, g, unknown or other
  modified_base (264)..(264): a, c, t, g, unknown or other
  modified_base (267)..(267): a, c, t, g, unknown or other
  modified_base (272)..(273): a, c, t, g, unknown or other
  modified_base (285)..(285): a, c, t, g, unknown or other
  modified_base (421)..(546): a, c, t, g, unknown or other
  modified_base (787)..(1347): a, c, t, g, unknown or other
  modified_base (1551)..(1551): a, c, t, g, unknown or other
  modified_base (1600)..(1878): a, c, t, g, unknown or other
  modified_base (1923)..(1923): a, c, t, g, unknown or other
  modified_base (1965)..(1965): a, c, t, g, unknown or other
  modified_base (1968)..(1968): a, c, t, g, unknown or other
  modified_base (1998)..(1998): a, c, t, g, unknown or other
  modified_base (2025)..(2025): a, c, t, g, unknown or other
  modified_base (2028)..(2028): a, c, t, g, unknown or other
  modified_base (2031)..(2031): a, c, t, g, unknown or other
  modified_base (2134)..(3003): a, c, t, g, unknown or other
atgcctttacgtttggatgttaaaagaaaattgctggctcgttccgatcgagttaaaagcgtcgatnnncatccaaatgagccgtggacgctagtttcgctctacaatggccatgtgcatatttggaatcatgagaatcaacaattggtcaaatcatttgaggtctgcgatctgccagtccgggcggccaaatttattgtgcgnaaaaattggatagnnacnggttcggatganatgcaanttcgcatcttcaattataatacnctngaaanntcatcaaatggnaagcttcatactgattatttgcgctcgatagctgtccatccaacccagcctttccttcttacctgctccgatgacaaactcataaaattatgggactgggaaaacgaatggaaattgaaacaaatttttgaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccacgagaagggggtgaattccgtggactattatcatggcggcgataagccatatctcatttctggtgccgatgatcacctaatcaaaatttgggaataccaaaatggaacatgtgtggccaccctggatggacatgcgcacaatgtttcagccgtgtgtttccatcctgaattgcccatcatcattagtgggtcggaggattccacagtgcgcatttggaatgcaaacacgaatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatcttctatgactgggacacgggccatgttatccggcgaattgagattgcggccaaacatgtttattggagtgagaatggcgatatggtggcaattgctggtgaggagtcactttacatactcaaatacgcggaagaggccgtcacaaatgctgacgaaattgggccggatggaattgaggaggcatttgaagtcattgtngaactcaatgaatcagtgaagaccggcttttggattggctactgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggattcaaaaaacaagcattggcagtgagcaaagacccccancaccgttttgaattggccttgtccctcggggatttacgcgcngcntacgagatggcccaacaagcggacagtgangagaaatggaaacaattggcccatgcngcnacnatcaaatcagaattacgattggccggagaatgcttggccaaggcccgagattttggcggtcttcttttactcgcatcctgtgccggctcaaatcgtttggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 550 - DNA, 1338 bp, Artificial Sequence
  Description of Artificial Sequence: Synthetic polynucleotide
  modified_base (1)..(246): a, c, t, g, unknown or other
  modified_base (418)..(1338): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggcgggagtatcagcgttgcggagattgtcaatttcattgacggcggtgggaatgtactggtcgcagccggctccaatttgggtgatgcaatccgggatttggcaacggaagttggcttcgaatttgacgagagcaaaacggcggtcattgaccatttcaactatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 551 - DNA, 504 bp, Artificial Sequence
  Description of Artificial Sequence: Synthetic polynucleotide
  modified_base (1)..(408): a, c, t, g, unknown or other
  modified_base (502)..(504): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgatccaacgggcgtatcgcatcaacgcctctacactatggaaaagttgcaagatgaacttcttgaggcagcccgtcaacgtggaacacgcnnn

SEQ ID NO: 552 - DNA, 585 bp, Artificial Sequence
  Description of Artificial Sequence: Synthetic polynucleotide
  modified_base (1)..(231): a, c, t, g, unknown or other
  modified_base (583)..(585): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtccgtgaattggaaaagaagatgagcggttgccacgtcatttttgttgccaagcggcggatcctcccaaaaccgcaacgcggcaaaaatcgcaaaccattgggccagaaacgccctcgttcacgaacattgactgccgtccacgaggcaattctccaggacattgtgtttccggccgaggttgttggcaagaggattcgcgtcaaattagacggaaaacaaacaatcaagattcatttggacaaagcgcaacaaaccaacgttgaacacaaagtggaaacattctcgcttctttacaaacgattgacgggcaaggatgtgaccttcgaatttccggagccaattttcnnn

SEQ ID NO: 553 - DNA, 2277 bp, Artificial Sequence
  Description of Artificial Sequence: Synthetic polynucleotide
  modified_base (1)..(3): a, c, t, g, unknown or other
  modified_base (115)..(117): a, c, t, g, unknown or other
  modified_base (150)..(151): a, c, t, g, unknown or other
  modified_base (162)..(162): a, c, t, g, unknown or other
  modified_base (164)..(164): a, c, t, g, unknown or other
  modified_base (174)..(174): a, c, t, g, unknown or other
  modified_base (177)..(177): a, c, t, g, unknown or other
  modified_base (192)..(192): a, c, t, g, unknown or other
  modified_base (195)..(195): a, c, t, g, unknown or other
  modified_base (197)..(197): a, c, t, g, unknown or other
  modified_base (204)..(204): a, c, t, g, unknown or other
  modified_base (207)..(208): a, c, t, g, unknown or other
  modified_base (212)..(213): a, c, t, g, unknown or other
  modified_base (218)..(218): a, c, t, g, unknown or other
  modified_base (220)..(220): a, c, t, g, unknown or other
  modified_base (223)..(223): a, c, t, g, unknown or other
  modified_base (235)..(543): a, c, t, g, unknown or other
  modified_base (634)..(636): a, c, t, g, unknown or other
  modified_base (642)..(642): a, c, t, g, unknown or other
  modified_base (646)..(646): a, c, t, g, unknown or other
  modified_base (649)..(649): a, c, t, g, unknown or other
  modified_base (651)..(652): a, c, t, g, unknown or other
  modified_base (654)..(655): a, c, t, g, unknown or other
  modified_base (663)..(664): a, c, t, g, unknown or other
  modified_base (669)..(670): a, c, t, g, unknown or other
  modified_base (705)..(705): a, c, t, g, unknown or other
  modified_base (708)..(709): a, c, t, g, unknown or other
  modified_base (715)..(716): a, c, t, g, unknown or other
  modified_base (719)..(719): a, c, t, g, unknown or other
  modified_base (730)..(732): a, c, t, g, unknown or other
  modified_base (735)..(736): a, c, t, g, unknown or other
  modified_base (738)..(740): a, c, t, g, unknown or other
  modified_base (744)..(744): a, c, t, g, unknown or other
  modified_base (746)..(746): a, c, t, g, unknown or other
  modified_base (748)..(749): a, c, t, g, unknown or other
  modified_base (754)..(754): a, c, t, g, unknown or other
  modified_base (768)..(768): a, c, t, g, unknown or other
  modified_base (822)..(822): a, c, t, g, unknown or other
  modified_base (846)..(846): a, c, t, g, unknown or other
  modified_base (854)..(854): a, c, t, g, unknown or other
  modified_base (858)..(861): a, c, t, g, unknown or other
  modified_base (867)..(867): a, c, t, g, unknown or other
  modified_base (871)..(871): a, c, t, g, unknown or other
  modified_base (873)..(873): a, c, t, g, unknown or other
  modified_base (876)..(876): a, c, t, g, unknown or other
  modified_base (879)..(879): a, c, t, g, unknown or other
  modified_base (882)..(882): a, c, t, g, unknown or other
  modified_base (886)..(886): a, c, t, g, unknown or other
  modified_base (888)..(888): a, c, t, g, unknown or other
  modified_base (894)..(894): a, c, t, g, unknown or other
  modified_base (1059)..(1061): a, c, t, g, unknown or other
  modified_base (1063)..(1066): a, c, t, g, unknown or other
  modified_base (1068)..(1072): a, c, t, g, unknown or other
  modified_base (1074)..(1075): a, c, t, g, unknown or other
  modified_base (1077)..(1080): a, c, t, g, unknown or other
  modified_base (1092)..(1093): a, c, t, g, unknown or other
  modified_base (1131)..(1131): a, c, t, g, unknown or other
  modified_base (1159)..(1159): a, c, t, g, unknown or other
  modified_base (1206)..(1206): a, c, t, g, unknown or other
  modified_base (1213)..(1213): a, c, t, g, unknown or other
  modified_base (1215)..(1218): a, c, t, g, unknown or other
  modified_base (1278)..(1278): a, c, t, g, unknown or other
  modified_base (1663)..(1674): a, c, t, g, unknown or other
  modified_base (1798)..(1798): a, c, t, g, unknown or other
  modified_base (1800)..(1800): a, c, t, g, unknown or other
  modified_base (1803)..(1803): a, c, t, g, unknown or other
  modified_base (1894)..(2277): a, c, t, g, unknown or other
nnnctgcgaatttgcaaacttccaacgaccgaatcttcactgaccaacaaggtgtacgtaaatcagcaggatttggatgccactttgaccaattttgttcgcgtccaaacatcannngtgcatcattatgttttctcattggccaaccannttggagtcaancnaggcgagatnggnttttcacttccacancgncnctggacnaanntctnnttggngnagnaaatacaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgtgaccttggcccgttgagcccaaatgccgttgtcatttttgatcgaccagagaattcccaaatcaatttgattggccgaagcaagnnnaaatcntcanacngnncnntgatcaannccganngggacttccaacaaatgggcattggtgggctgganaannagttcnntgncatcttccgcnnngcnntnnnttcncntnncttcncgcccgaattcatngaacaattggcaatgaagcatgttcgtggcattctcctctttggcccacctggnaccgggaagacattaattgcacgncaggttgnaaannnnttgaangccngnganccnaanattntnaatggncccgaaatactgaacaaatacgttggcgaatccgaggccaacatgcgcaaattgtttgccgaggcggaggaggaatttcgtcgctgtggctccaattccggtttacacatcatcatttttgacgagattgatgcgatttgcaagcagcgaggtcaagccggttcnnncnnnngnnnnnannannnnattgtgaacacnntgctagcaaaattggatggtgtggaacaattgaacaanattttgatcattggaatgacaaattttntggacaccatcgatccggccttacttcgacctggccgtctggaattncaagtgnannnntcgctgcccgatgagcatggccgagtgcaaattttgaaaattcatactgcccgaatgagngaatacaaaaaattggacccgagcgttgatctggcggagattgggcgcaagacgaagaatttttctggtgccgagctcgaaggccttgtccgtgctgcccaatcatcggcgatgaaccggctggtgaaagcgggaggcaaagtccaggtggatgaggacgccgtggagaagctgatgatcacccgcgatgatttcgactatgcgctggaaaatgacgtcaagccggcctttggccataatgacgaggagttgggccgattgctctacggtggactcgtttgctggggcgatccggtgacacgcgtgctcgaccaaggcgatttattgatcaaagaaacggcggcaatcgacacccgaggatttgtgcgagcacttttggccggtnnnnnnnnnnnngggaaaacatatttggccgcgcacattgcccgaaaatcggagtttcccttcatcaaagtgtgcacgccggaggacatggtcggctacagtgagacagcaaaatgtgcccaattgagaaaggttntngangacgcctacaaatccccgctgagctgcatcatcatcgacaacatcgaacgactccttgactactctccgattgggccgcgctattccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 554 - DNA, 783 bp, Artificial Sequence
  Description of Artificial Sequence: Synthetic polynucleotide
  modified_base (1)..(84): a, c, t, g, unknown or other
  modified_base (258)..(258): a, c, t, g, unknown or other
  modified_base (301)..(303): a, c, t, g, unknown or other
  modified_base (436)..(438): a, c, t, g, unknown or other
  modified_base (441)..(442): a, c, t, g, unknown or other
  modified_base (613)..(783): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnaagggtagtccttttcttaaattgaaatattatgccaaccgtggaatcgatactccaattacttggtttcgtgaatcaattgttgaacctatgcaagatcgttttcgaaagccatattatcaccggcgatttgatcgggttcccgaaattgatcaatgcggggttttggacggntttgcattttttgaagccaatgaacaatatcgattcgataaannngtcgacaccctaatcatgaaaattctctatgatcgtctgtatagatgtatgaaatttcatgatagagcattcgtaaaatgctcaaaagtgttggatgaatatcacgaaaatgatttgaattttttcattaaannnggnnaaatcggccaaccgtcggatgtgatcgacgcatatatgaaacaaaaacatcgtctgatttgggaaaggcgccatcccgaaataatggctgaaagaaagcgcgtcgaagaggaccacaaaaaggcagtggaagaaggaaaattcgacttgagattttggacaaggtaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 555 - DNA, 1488 bp, Artificial Sequence
  Description of Artificial Sequence: Synthetic polynucleotide
  modified_base (1)..(84): a, c, t, g, unknown or other
  modified_base (274)..(552): a, c, t, g, unknown or other
  modified_base (582)..(582): a, c, t, g, unknown or other
  modified_base (594)..(594): a, c, t, g, unknown or other
  modified_base (612)..(612): a, c, t, g, unknown or other
  modified_base (630)..(630): a, c, t, g, unknown or other
  modified_base (820)..(822): a, c, t, g, unknown or other
  modified_base (826)..(829): a, c, t, g, unknown or other
  modified_base (831)..(831): a, c, t, g, unknown or other
  modified_base (834)..(835): a, c, t, g, unknown or other
  modified_base (838)..(839): a, c, t, g, unknown or other
  modified_base (841)..(847): a, c, t, g, unknown or other
  modified_base (849)..(849): a, c, t, g, unknown or other
  modified_base (852)..(853): a, c, t, g, unknown or other
  modified_base (856)..(859): a, c, t, g, unknown or other
  modified_base (1053)..(1053): a, c, t, g, unknown or other
  modified_base (1098)..(1098): a, c, t, g, unknown or other
  modified_base (1134)..(1134): a, c, t, g, unknown or other
  modified_base (1146)..(1146): a, c, t, g, unknown or other
  modified_base (1152)..(1152): a, c, t, g, unknown or other
  modified_base (1155)..(1155): a, c, t, g, unknown or other
  modified_base (1161)..(1161): a, c, t, g, unknown or other
  modified_base (1167)..(1167): a, c, t, g, unknown or other
  modified_base (1173)..(1173): a, c, t, g, unknown or other
  modified_base (1189)..(1189): a, c, t, g, unknown or other
  modified_base (1420)..(1488): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnngatgctgatcttgttgtaatcggctctggaccgggcggctatgtggccgcaatcaaagccgcacaactcggtatgcgcacattttgtgttgagaagaacgatacattgggtggaacttgccttaatgttggctgcatcccttcaaaagcgttgctcaacaattcccattactaccatatggccaaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggttgtttcatccactggtgcattgtcnttgaaaaaagtncccgaaaaaatggtcgtnattggagccggcgtcatnggattggaattgggcagcgtttggcaaaggttaggcgccgaagtgacggcagtggaattcctcggctcaattggtggtgtgggcattgacggggaagtggcaaaacaattccaacgacttttgaccaaacaaggcatcaaatttatgctcaacacaaaagtgatcagtgcaaaaatccagtggcaaaatnnntcannnncngtnnaanntnnnnnnnanggnnaannnnaagaagtaactgcagattacctgctcgttactgtaggacgtcgtcctaatacagacggactcggtcttgatatgatcggtgttgacgttgatgagcgcggattcgttaaagttgaccaccaaggtcgcactagcatcccgcacatcttcgcaattggtgatatcgtatctggtcttgctctggcacacaaatcnaaggatgagggaattttggcagtggaaggaatggccggcggcgcngttcacattgactacaattgcattccatccgtcgtntacacacatccngaggtngcntgggtnggcaangcggangaacaactcaaacagnagggcatctcctataaagtgggcaaatttccattcgtcgccaattcccgggccaagaccaacaatgatgtggaaggatttgtcaaagttttgggcgagaaagaaaccgatcggctgctgggcgttcacattgttgggccgaatgccggtgaaatggttgccgaagcgacattggcattggaatatggagccagttgcgaagacattgcccgcgtttgccatcctcatccgnnnnnnnnnnnnnnnnnnnnnnnnnnnnnnnnnnnnnnnnnnnnnnnnnnnnnnnnnnnnnnnnnnnnn

SEQ ID NO: 556 - DNA, 3522 bp, Artificial Sequence
  Description of Artificial Sequence: Synthetic polynucleotide
  modified_base (1)..(153): a, c, t, g, unknown or other
  modified_base (364)..(579): a, c, t, g, unknown or other
  modified_base (649)..(759): a, c, t, g, unknown or other
  modified_base (1024)..(3522): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaatgtggtcaaaacgctgttggaatgccggataagtgcagccaatttcaatttgatcaaagtgattggccgcggcgcattcggcgaagtccaactggttcggaatgcgcagaacaaaaaagtgtacgcgatgaaattgttggagaaggagaaaatgagcaaacgcaccgatgcggcattcttttgggaagagcgcgacataatggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataacatgctaatttccgcatctggtcacatcaaattggccgattttggcacttgcgtcaaaatgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggccgttggcgtcacaatgtacgaaatgttggtcggggaaacgccgttctactccgactcgttgatcaccacctatcagcggattcaagagcacaataaacatttgaaatttccggacgatgtgaaaatgtccaatcaggcaaaggacattgttcgcaaatttttggccgaaccaaatgtgcggttgggaaaggacagtgtggcggggattaaagcgcatccattcttcaaaaatgcacaatggaattttgacacaattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 557 - DNA, 837 bp, Artificial Sequence
  Description of Artificial Sequence: Synthetic polynucleotide
  modified_base (1)..(291): a, c, t, g, unknown or other
  modified_base (412)..(414): a, c, t, g, unknown or other
  modified_base (558)..(558): a, c, t, g, unknown or other
  modified_base (699)..(699): a, c, t, g, unknown or other
  modified_base (781)..(837): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacaccggcaattccggcaaaggattggacaattttgcccggcgatttggtggaagtgatggtcggcagggacaaaggaaaaagaggccatgtaatgcacattttacgcgaaaatgcannngtttatgtggaaggattacacacaaaattgatggataaaatagaaaaaatgcaaaaatatatgctctcaatgaacgccaaatttatggaacagccattatttgtgcatcgacaggaagtgatgctcatcgattcaaatgatgangaaccctgtaatgcccaatggattttgaacaaggagaagacggactatgtacgtgtgagcacccgaaccggctatgaaattccaattccaaaggccgcctatcgcaattatgaatataaaacaccggaagaatacattgantgcaaggaaaaggacacaccggccaatgaagtcctaaaacacacatatcaaccaaaattgtgcacttttgagcaggaaattnnnnnnnnnnnnnnnnnnnnnnnnnnnnnnnnnnnnnnnnnnnnnnnnnnnnnnnnn

SEQ ID NO: 558 - DNA, 480 bp, Artificial Sequence
  Description of Artificial Sequence: Synthetic polynucleotide
  modified_base (319)..(480): a, c, t, g, unknown or other
atgaagttggaaacttgcgtttattctggctacaaaatccatccaggacatggcaaacgagttgttcgttctgatgggaagatccaaattttcctgagcgccaaatgccaacgtggttctgcattgaaacgcaaccctcgggatgtgccatggaccgttctctatcgccgaaaacataaaaagggagttcacgctgaggaaggccagcagaagaagcgagtgaaacgcacagtgcaagtggcctcccgaccgatcgccgatttgaccgtggaagcattgttggctcaacgcaaccaaaaacccgaattccgaaagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 559 - DNA, 627 bp, Artificial Sequence
  Description of Artificial Sequence: Synthetic polynucleotide
  modified_base (1)..(54): a, c, t, g, unknown or other
  modified_base (73)..(73): a, c, t, g, unknown or other
  modified_base (75)..(75): a, c, t, g, unknown or other
  modified_base (84)..(84): a, c, t, g, unknown or other
  modified_base (86)..(86): a, c, t, g, unknown or other
  modified_base (99)..(100): a, c, t, g, unknown or other
  modified_base (102)..(102): a, c, t, g, unknown or other
  modified_base (107)..(109): a, c, t, g, unknown or other
  modified_base (111)..(111): a, c, t, g, unknown or other
  modified_base (117)..(117): a, c, t, g, unknown or other
  modified_base (119)..(120): a, c, t, g, unknown or other
  modified_base (123)..(123): a, c, t, g, unknown or other
  modified_base (125)..(125): a, c, t, g, unknown or other
  modified_base (127)..(127): a, c, t, g, unknown or other
  modified_base (133)..(133): a, c, t, g, unknown or other
  modified_base (135)..(135): a, c, t, g, unknown or other
  modified_base (138)..(139): a, c, t, g, unknown or other
  modified_base (141)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (164)..(165): a, c, t, g, unknown or other
  modified_base (169)..(169): a, c, t, g, unknown or other
  modified_base (171)..(174): a, c, t, g, unknown or other
  modified_base (176)..(176): a, c, t, g, unknown or other
  modified_base (186)..(187): a, c, t, g, unknown or other
  modified_base (192)..(192): a, c, t, g, unknown or other
  modified_base (194)..(199): a, c, t, g, unknown or other
  modified_base (201)..(204): a, c, t, g, unknown or other
  modified_base (208)..(208): a, c, t, g, unknown or other
  modified_base (210)..(211): a, c, t, g, unknown or other
  modified_base (213)..(213): a, c, t, g, unknown or other
  modified_base (231)..(231): a, c, t, g, unknown or other
  modified_base (288)..(288): a, c, t, g, unknown or other
  modified_base (315)..(315): a, c, t, g, unknown or other
  modified_base (322)..(326): a, c, t, g, unknown or other
  modified_base (328)..(329): a, c, t, g, unknown or other
  modified_base (333)..(333): a, c, t, g, unknown or other
  modified_base (529)..(627): a, c, t, g, unknown or other
nnnnnnnnnnnnnnnnnnnnnnnnnnnnnnnnnnnnnnnnnnnnnnnnnnnnnnaaattcaaattggtccttntnggcgaatcngntgttggcaaatcnncnttggnnntncgattngnnaangncnaattcnangannannnngantcnacnatnggngccgnnttcntnnnncnaacaatttgnntggangnnnnnncnnnnaaantnnanatttgggacaccgctggncaggaacgtttccgctcgataaccccaatgtacattcgaggggcaaaagcggccatngttgtctatgacatttcaaatagggtntcctttnnnnnannaaanaattgggtccgtgaattgcaacgtcaagcatcgccaacaattgtgatcgcattggccggcaacaaagcggatatggcggccaaaagagttgtggaatatgaggaggcacaggcatatgccgaggacaatggcctacttttcatggagacatccgcaaaatcatcgatgaatgtcaacgacattttcctcgcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 560 - DNA, 7662 bp, Artificial Sequence
  Description of Artificial Sequence: Synthetic polynucleotide
  modified_base (135)..(135): a, c, t, g, unknown or other
  modified_base (397)..(567): a, c, t, g, unknown or other
  modified_base (661)..(663): a, c, t, g, unknown or other
  modified_base (679)..(679): a, c, t, g, unknown or other
  modified_base (684)..(688): a, c, t, g, unknown or other
  modified_base (690)..(690): a, c, t, g, unknown or other
  modified_base (694)..(695): a, c, t, g, unknown or other
  modified_base (700)..(704): a, c, t, g, unknown or other
  modified_base (708)..(714): a, c, t, g, unknown or other
  modified_base (738)..(738): a, c, t, g, unknown or other
  modified_base (771)..(771): a, c, t, g, unknown or other
  modified_base (777)..(777): a, c, t, g, unknown or other
  modified_base (804)..(805): a, c, t, g, unknown or other
  modified_base (810)..(810): a, c, t, g, unknown or other
  modified_base (813)..(813): a, c, t, g, unknown or other
  modified_base (815)..(815): a, c, t, g, unknown or other
  modified_base (817)..(817): a, c, t, g, unknown or other
  modified_base (819)..(820): a, c, t, g, unknown or other
  modified_base (824)..(824): a, c, t, g, unknown or other
  modified_base (828)..(828): a, c, t, g, unknown or other
  modified_base (838)..(840): a, c, t, g, unknown or other
  modified_base (945)..(945): a, c, t, g, unknown or other
  modified_base (1153)..(1188): a, c, t, g, unknown or other
  modified_base (1279)..(1848): a, c, t, g, unknown or other
  modified_base (2007)..(2007): a, c, t, g, unknown or other
  modified_base (2020)..(2020): a, c, t, g, unknown or other
  modified_base (2025)..(2025): a, c, t, g, unknown or other
  modified_base (2151)..(2151): a, c, t, g, unknown or other
  modified_base (2371)..(3045): a, c, t, g, unknown or other
  modified_base (3310)..(4260): a, c, t, g, unknown or other
  modified_base (4417)..(4557): a, c, t, g, unknown or other
  modified_base (4897)..(5604): a, c, t, g, unknown or other
  modified_base (6075)..(6075): a, c, t, g, unknown or other
  modified_base (6208)..(6333): a, c, t, g, unknown or other
  modified_base (6523)..(7215): a, c, t, g, unknown or other
  modified_base (7435)..(7437): a, c, t, g, unknown or other
  modified_base (7527)..(7527): a, c, t, g, unknown or other
  modified_base (7654)..(7662): a, c, t, g, unknown or other
atgggcgttctcacattaaacatcgaaagccatgagcgaggtgttaagaaaacaatgcaatttgagccaaggacattggtccatgatgcttgccggcttatccgtgataaattgggacctatgccaggaaatcgnaatgattatggcctgtttcgtgttgaagatgacccatcaaaatgtgtttggatggaaaatgggcgaacattggaatattatttgattcgaaatggagatacattggaatacaaaaataaaattcgatcattgcgtgtgcgaactttggatggcagctgtaaaacaatttttgtggatgaatcccagccagtcgaacaattgatggtggttatttgttcaaaaatgggaatagccaatcatgacgaatattctctggttcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcaaaattgcatacggatgaagaactccattgggtggaccattcaaaaacattacgcgaacaaaatattgggaggatgaagagtgacattnnngcgaaggaaattcttntctcnnnnncnaatnnggatnnnnncgannnnnnncaattggatgccctctatgaacgntgtttggaccaagttcttcgaggattccatccngtctcnagggatacggccattcgactggctgcnntccantgntncntnnaatntggnccattcgaannngagggaatacaacggaatgttgattcgaagaatttattgccaaaagaatatgcaaaggcaaaagaattggagaaaaacatcattcaagaatatcgagaattaatntatgaggattctgctgcaccaaaaaagaaatattgtgaattgtgccaatcattgccaacttacggtgtcacatttttcttggttaaagagaaattacccggcaaaaatcgtttaattccccgtttgcttggggtaaacaaagattccgtgatgagagttgatgaacggacaaaagcggtgctcaaagaatggccacttgaacaagttnnnnnnnnnnnnnnnnnnnnnnnnnnnnnnnnnnnngactttggcgactatcaagatggctattattcagtccaaacattggaaggtgacaaaatcaaaaaattgattgccgaatttgtggacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccggaaatgggccgaggagttcgagaattggctgccctaatgccggatgaacaccgtggtgatttggtggatgcggcccgaaaattgtgcggagcatttggagaatttttggacaaagttcatccggaacgacaagaaaaaagagcaaatattttntcggcggccagtngagtnggtgaactttcgcacgatgtgatcagcacaatgcaggagaggacagaagaagaacggtcgttccacgatgaactcaatcgaaaggcacgagccgtggccacaagcaccgccaactcgttttacagngcaaaaacagtttcggctgattgtgaagagcccgttttgaaggatcaagtcatccacagtgcaatgaaaacggcatttgccacttccgaattggttgcctgcactcgagtggttggaccaacaattgagcaccaaccatgcaaagaacatttgactgatgcggcgcacaatgttgctcgagcagttcaagatttgttggatgatgccggaaaagctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagctggattaatccacgaatcacaggcaattatcgatccggcaactcgcttagtcgatgttagccgttccactgtttcgcatgttggcgataaacatgcagccggaatattaattcaaagcagtcaacaactttcggtacaaattgccgaattacgttcccaactgaataatgcacaacaactcaattttgaaccacaattggaacattctgaagatttaatcaatgcattggaccatcaattacaagaatggcacaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgaatggattagcccattttgcgaggcgagatgacactgaacaattatgtctggcagtgcgaaaagtttcgaatgctgtttgtggattagcgaagaatgcggcccaatcagcctatttaattggcgttggtgatccgcagagtgaaccaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcaaatatttgtcgcgatgcttcagaaaaatcagcaaatgtcagtgtgcggactcaatttgtgaacagtgcccgcgaaataacttcaattactgctgcattaatcactgatgttaaacgttttgatcaaacccaatcagcgaataatgaatgtacggaacaagcaaaaaaattgcgatcagctgttgagaatttacaaaaatatttggataatcccgattttggaccaattccggcaaaaatttcaccggaagggaggaaagcacaggaacccctaattagatcagcgaaacaaatgctcgattcaagttcagaaatgatcgagtgagtcaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccgaatggttaccgctttgaatgaaattgcacaatcggcatcggatgcacatttagtccaaccaaatgacattggtcaactttcacttcgacttgctgagaatttccgatcactagccgaggacacacaaattgcgcaaaatttattgatgaattcggaacttggacaaaaaatgaaagctagcgtccaaaaattgggaacagtttgcattgaattggtcaaattgagtggtcaaaggcgaaattatccaaatgatcagcgagtttatcagcaactttcccagcattctgtgctggtccaagaacgggtgcgtgaagtgttggcaatcctttcagaaggctctcgcggcacacaagcctgcataaatgccgcccaaacagtttctggaataatcggcgatttggacacaacaattttgttcgccacttccggttcattgaatcctccgcaacaggcacaacaacaaatncatcgagatgttattatcaaaacagccaaagctcttgttgaagatacgaaggctttggtcagcggtgcagcctcaaatcaagaacagctggctgtggctgcacaaaatgcagttcgaacaattttacaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttctggtcgaagcccaaatgatccggcaattggaaatttgaaggaagcagcaaaagtgatggtcagcaatgttagtggtcttttgcgagcaattaaaacagtggaggattcttcccaacgaagtgttcaggcattggaggctgcggtcaatgccatcgatctggccgttaaacaatacgacaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatggaccgaaggattggtcactggtgccaaacttgtcgcagcggccacatcccaattatgcgaagcggcaaatggcctcatccggggtcattcgacagaggaaaaattaattgcagcagcgaaacaagtggcctcatccacagcacatttattggtcgcctgcaaagttaaatccgatttggacagccgtgccatgcaacgactccagagtgctggcnnngcagtaaaaacagccacagaacatttggtgaacgcagccagacaagtcataaccgaagaagattgtcgaggattggttatttccgatganatggtttatggaattgcacaagttatggatgctcatgaagaagtactgagaaaagaaaaggaattaaacgaagcccgaaatcgattggcccagctaaacaaatcacgctatgaaaaatcaccggaannnnnnnnn

SEQ ID NO: 561 - DNA, 1575 bp, Artificial Sequence
  Description of Artificial Sequence: Synthetic polynucleotide
  modified_base (1)..(831): a, c, t, g, unknown or other
  modified_base (1009)..(1575): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcatcgtgaaacgtatcatcttatgatcgattacattgatcgttatcttggagacaaacggctgcaggttcatccccaaagacttcaacttattggcgccaccgctatgctcattgcagcaaaaatagaggagatctatccacccagagtttgtgaaattgccgaatacactgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 562 - DNA, 1572 bp, Artificial Sequence
  Description of Artificial Sequence: Synthetic polynucleotide
  modified_base (1)..(246): a, c, t, g, unknown or other
  modified_base (391)..(1572): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgttggcaatcggctgaatgattattacaaaatgcaacaaattgtaaattggttgcctacaataaaggaaaagattgattttgtgaatccctatgaacgagaatggcgcgttcctgagaagaaatggcacaggtttaaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 563 - DNA, 1347 bp, Artificial Sequence
  Description of Artificial Sequence: Synthetic polynucleotide
  modified_base (588)..(588): a, c, t, g, unknown or other
  modified_base (712)..(822): a, c, t, g, unknown or other
  modified_base (1081)..(1347): a, c, t, g, unknown or other
atggtagaaataggacaatttgaaataagaaatgtgtcaaaaattgaacgaattggtgcccattcacatattattggtctcggacttaaagaaaattatgagccgatgcatatttctcaaggaatggttggtcaacatgcagcgcggaaggcagccggtcttattgtcaaaatgattaaggatggccatattgctggacgagcacttttgattgttggagaaccaggcactggaaaaactgcattagcgatgggaatttctaaatccattggggcggatacaccatttttatccatttcagctagtgaagtttactcaatggacatgagcaaaactgaagcattaacacaagtattccggaaggctattggagtgagaatcaaagaagagaccgaaattttgaaaggagaagttgttcaagttgaaattgatcgtcctgcatcgggaactggcccaaaaattggcaaattaacattgaagacaacggatatggaggcgatttatgatattgggagtaaaatgacagaatcaataatgaaagaacgcgttattaccggcgatgttattcaaattgataagggaacaganaaaatcaataaaattggacgctcaattgccaaatccaaggattatgacgcacttggtccgcaagtcaaactggttgcttgtccctctggtgaaattcaatctcgggtggagacaatgcacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtgatggaatggcgtgaagaaaataaagcacaaataattccgggagtgctgtttgtcgacgaagttcatatgttcgatttggagtgcttttcatttttaaatcgttacattgaatcggatctttcgcccattttggtgatggccaccaatcgcggaattgtcaacatccggggcacttcaatcgaatcaccgcatggagtgccattggatttgttggatcgttgtctgattattcggaccaacaaatattcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 564 - DNA, 645 bp, Artificial Sequence
  Description of Artificial Sequence: Synthetic polynucleotide
  modified_base (160)..(645): a, c, t, g, unknown or other
atgggccgacgaccagctcgctgctatcgttacatcaaaaacaagccatatccaaaatcacgtttttgccgcggtgttcccgacccgaagatccgaatttttgacctgggacggaagcgtgcaactgttgatgaattcccttgctgtgtgcacatgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 565 - DNA, 1221 bp, Artificial Sequence
  Description of Artificial Sequence: Synthetic polynucleotide
  modified_base (1)..(147): a, c, t, g, unknown or other
  modified_base (334)..(450): a, c, t, g, unknown or other
  modified_base (606)..(606): a, c, t, g, unknown or other
  modified_base (655)..(903): a, c, t, g, unknown or other
  modified_base (1219)..(1221): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgcgataatcaaaaattatatgacaaatctgaaaatgacatcagagcattgcaatctgttggacaaattgtgggcgaagtattaaagcaattgaccgaggaaaagtttatcgtcaaagcaacaaatggaccgcgttatgtcgtcggatgtcgtcgatccattcctcgggagaaactcaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagattggaggactttcggaacaaattcgggaattacgcgaggtcgttgaattgccattaatcaatccggaacttttcaagcgcgttggcataacaccacccaaaggatgtcttttgtatggaccaccgggcactggaaaaacattattggccggngctgtggcttcccaattggactgcaatttccttaaagtggtttcttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggatcctgcattattacgaccgggacgccttgaccgcaaaattgaaattccgctaccaaatgaacaaagccggcttgaggtattgaagattcacgccaccaaaataaacaaacaagagccaattgattatgaagcggtggtcaaactgtccgaaggattctccggcgctgatcttcgcaatgtttgcactgaagccggattgaatgctatccggaaagaacggaaatatgttattcaagaggatttgatgaaagccgtcagaaaagtgggagaagcgaagaaactcgaaacgaagcttgattataaaccaattnnn

SEQ ID NO: 566 - DNA, 1683 bp, Artificial Sequence
  Description of Artificial Sequence: Synthetic polynucleotide
  modified_base (1)..(6): a, c, t, g, unknown or other
  modified_base (459)..(459): a, c, t, g, unknown or other
  modified_base (499)..(1683): a, c, t, g, unknown or other
nnnnnnaaaggcttccaaaattttatgtccaagaaggacttccatccaagtgcatggtggaatctaaaaagaaaatgggaagcggaacaaaaggacgacatggaaaagaaacgacaagaagagcttcgagttcaatatcaaaaggaacaggaaatgttcaacaacaaagcattgttgggcgatgaaaaagccaggcttggcctctcattcatgtacgatgcaccggctggaatcaataagaaaaaagaagaaggaccagagccaaaatttgaatggcaacgaaaatacaatgcaccgcgagaagattgggccaaagggaatgaactgatccaggaccagccattcggtatccaggttcgaaatgttcgctgtgtgaaatgccgaacatggggccatttgaacacagaccgagaatgtccactctatgggatgagtgggaatgcggaagaatcgggaatngcaaataatccatcggatttgatcaaggaattgcatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 567 - DNA, 564 bp, Artificial Sequence
  Description of Artificial Sequence: Synthetic polynucleotide
  modified_base (237)..(237): a, c, t, g, unknown or other
  modified_base (294)..(294): a, c, t, g, unknown or other
  modified_base (385)..(387): a, c, t, g, unknown or other
  modified_base (490)..(492): a, c, t, g, unknown or other
  modified_base (562)..(564): a, c, t, g, unknown or other
atgggaaaagttcattactgcaaacgacccgacaacacaacaaaatcgtgcaaggcccgcggttccgaccttcgagtccatttcaagaatacgcatgagacggcccgtgccatcaagggaatgccgctgaaacgtgccacccgtttcttggagaatgtgaaggcgaagaaggaaattgtgccattccgacatttcaagggaggcgttggtcgcaaggcacaggccaaagcttggganaccacacaaggacgttggccaaagaagtcggccgaattcctgcttcaacttttgaanaatgcggagagcaatgcggaagtgaaaggccttgatgtggaccatctgatcatcgaccatattgtggtgcaagctgcagccaaaatgcgcnnncgcacctatcgggcccatggccgcatcaatccgtacatgagctcgccatgcctcattgaagtgattttgactgagaagaaggatgttgtggcaaaaccggctnnnggcgctgtggtcaaagtgaagaaagagtcgaagaagaagcaaagacgtcaattggccaagggcgaatatnnn

SEQ ID NO: 568 - DNA, 3627 bp, Artificial Sequence
  Description of Artificial Sequence: Synthetic polynucleotide
  modified_base (1)..(405): a, c, t, g, unknown or other
  modified_base (496)..(498): a, c, t, g, unknown or other
  modified_base (1048)..(1377): a, c, t, g, unknown or other
  modified_base (1639)..(1641): a, c, t, g, unknown or other
  modified_base (1990)..(2166): a, c, t, g, unknown or other
  modified_base (2293)..(2454): a, c, t, g, unknown or other
  modified_base (2572)..(2577): a, c, t, g, unknown or other
  modified_base (2638)..(2640): a, c, t, g, unknown or other
  modified_base (2671)..(3627): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagtgaaatgactgaagaggaaatggagcgctattttcaagagaaacatgccaacaggccaccacccatcaaggcgagtgacgaggatnnngcctacgatgatatcactcaaaatggactattgccaagcaccaaagaccctaatttgtggattgtcaaagtcagattgggcgaagagaagaccacttgccttcaacttatgcgcaaatatttggcctatcaaaacacggaagaaccacttcaaatcaaatcggttgtaatgaaagaaggactgaaaggcatgctctacattgaagctttcaaaaaggcgcatgtagcaaaagcaattgaaggagtgtctgccatcaatcaatacaccataacgatggttccaatcaaagaaatggccgacacattgaaagtggtcaaagacacgccaacacttaagcccggttcctatgttcgattggctcgcagtctatacaaagatgatttggcacaagtcgactgggtcgatgttgcacagaacagagtgcatttgaagctagttcctcgtattgattacaccaaactgcgtggcgcactcaaaaatgaggagaatcgtccgttgcgcaacaaacgtcgtccattatcagcaccattcgatttggaccgaattaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacctctaacattgaatgcttacgaattgcgaaaatatttcaaagcaggagatcatgttcgagtgattgaaggccgatatgagggtgacaccggtctaattgttcgtgtcgaggacaaagtggtcatactcctttctgacttgactatgggagaaatgaaagttttgcccacggatgtccaactttgtacggaagtggccactggtgtcgaacgaatgggtcaatatcaatatcaggatttggtgatgttggacaaggaannnaccgtcggtgtgattgtccgcctggaaagagaacatgtggaagtattgaacatgcatgggcgattagtgcgaattaatccacaaacaatcgaaagcaaacgtgactcaaaatttatgaaagctttggattcgcagaaaaacacaattcaagttggggacatggtcaaagtggtggaaggaccgaatgcgtcacgcaaagaatctgacgaagataagcaaggcgaaatcaaacatatttaccgcaattgggtgttcgtcttttcccgaaaacatgcttccaacagcggcatttttgtatgcaaaggaaagcaattattgttggttggcggtttgaaagtaccgacgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcaagttcgccggaatatgggaatgattggaaaaacggtccggatcagagcaggtccaatgaaaggctatattggaattgtgaaagatgcaacggattccacagtcaaagttgaattgcatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgctcgcactccgcactacggttcaatgacacccgcatatgacggaagccgtacaccttctcatcaaccatccgcttcctgggacccaaccgttgccaacacaccggcacattcannnnnnactgcacatttcgatgatgaattcgattcgatgggtttcggtggggcagcaacaccagctnnnggcagtcgatatggtggtgccacaccggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 569 - DNA, 3735 bp, Artificial Sequence
  Description of Artificial Sequence: Synthetic polynucleotide
  modified_base (126)..(126): a, c, t, g, unknown or other
  modified_base (249)..(249): a, c, t, g, unknown or other
  modified_base (397)..(1104): a, c, t, g, unknown or other
  modified_base (1371)..(1371): a, c, t, g, unknown or other
  modified_base (1465)..(3102): a, c, t, g, unknown or other
  modified_base (3313)..(3735): a, c, t, g, unknown or other
atgctctctaggaaaagaaaaaaccctctacaaaattatctacaatcattatcaactccactagaaaagcgtcaaaaatctgaacaatttcaagagaatttgcgtgcattttaccggcggaaaggnggttttcccgtaaagtcgccttatataaatggcaaagaattggatctgtttgaattgtatgaaatagttgttggccttggggggtggcaaaaagttacaactttcgatcgatgggatgaattncttcataaattatcattggatgaaaacattcaaatggcagagcatgcggttcgcactctttatttgaaatatctcagcaggtttgagcaaaacgagaatgatggagatattgcggatgaacatgaaaatgaattattgggaggaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatcatcgaagatggattaaattctaatgataaattcaaattgcttcgatccatggaaatcatttctggcctttgtcaaaatgcaataaatgaaacgctgatttgtgaatttttggacagatctattatcgatcgaattttcacacttcttccaatcaaagatattttgatttacactgtctccttggaaactttactacaaatatcggaattggggaaaacttcctgcgaattgattggctccaacaatgcttcaatcgattancttgttggaatgctcaccaccgacgcagcctctttcggacaagctgggctttatggtatcaaagtggttgaagtccgcgggaattccatgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagagaacgagacaatcaacatggctattcaccattcgctgcatatgaggcaattcggcgacacgcatttgaatatttgaaaaaggaaattacggatgattcggaggggcctgtgacgaaaaatattcggctcactgctgcattgattctgaggaatgtttgtaaaaattcggtttcggggagaagaaagctaagaaaacatgaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 570 - DNA, 2406 bp, Artificial Sequence
  Description of Artificial Sequence: Synthetic polynucleotide
  modified_base (1)..(324): a, c, t, g, unknown or other
  modified_base (538)..(555): a, c, t, g, unknown or other
  modified_base (775)..(775): a, c, t, g, unknown or other
  modified_base (777)..(777): a, c, t, g, unknown or other
  modified_base (779)..(783): a, c, t, g, unknown or other
  modified_base (785)..(788): a, c, t, g, unknown or other
  modified_base (790)..(790): a, c, t, g, unknown or other
  modified_base (792)..(792): a, c, t, g, unknown or other
  modified_base (1015)..(2010): a, c, t, g, unknown or other
  modified_base (2188)..(2406): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctcgggattggcacaaaatatttcgggccgagttgcccaattggatttgggcaaaagcagagtggtcgaatgtttacaacgcatgaatgatttgagagatttgggtgcatgtgccagtggagtgcaagaggcaataaaaacggaggattttgaggaggcagcaaggcatattcaccggtttttgacacttgaccgagcaattttcaaaatgnnnnnnnnnnnnnnnnnngatgccggctattctgttaagaattcctatgaaatacttggacaagcggcaattgaattaaaaggaataattgagcagaaattcgattcagcaaaggcaaaaggcgatgtggcatcaatggaacgttttttcaaattatttccactaataaatgaacatcaaaatggattgaatcgatttggtgcgcatctttgccagagaattgcggaattgggtgaananannnnnannnnantncaggccggcggaacggatgataatcgaaaaagtgtgttattcgcggacacactgacaatgatattcgagggaattgcccgattgattgaattgaatcagccaattattacgaataattatggccaagaaaaattgctcgatttgatcgaaattattcaacctgaatgcgacaaacaaaccagccgagtgttggaggcattcattcaaaaaaggcaattcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtaattttacgaaaatataaaattattttaataatattttttcaggcattattaatttccgtctccaacgaaatattccaacaatttgaaagagtgatattcaaatgcaatttcaacagattgggcgttttacaattggataaagaatttcgtgaacttatttcatatttgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 571 - DNA, 1278 bp, Artificial Sequence
  Description of Artificial Sequence: Synthetic polynucleotide
  modified_base (1)..(342): a, c, t, g, unknown or other
  modified_base (423)..(423): a, c, t, g, unknown or other
  modified_base (496)..(510): a, c, t, g, unknown or other
  modified_base (765)..(765): a, c, t, g, unknown or other
  modified_base (858)..(858): a, c, t, g, unknown or other
  modified_base (1113)..(1113): a, c, t, g, unknown or other
  modified_base (1258)..(1278): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgccacactcgtgaattggctttccaaatctcaaaggaatatgaacgattcagcaaatatatgccaggagcaaaagtntttccgtcttttttgggggatgcccatcaagaagatgaagagaccttggccaagaacactccgcacattgttnnnnnnnnnnnnnnncggctgctggctttggggcgaactggtcaattgaagctgaagaacatcaaattcttcgttctggacgaatgcgacaaaatgattggagatgccgatatgcgccacgatgtgcaggaaatcttcaagatgacaccacaggagaagcaggtcatgatgttcagtgccactcttccacgggagctgcgcgtcgtttgcaagaaattcatgcaggaaccaatggaagtttatgtggacgatgaggccaaactcacattncatggacttcaacaatattatgttcgactgaaggagaatgagaagaaccgaaagcttttggatctgttggatgccctcgaattcaaccaagtngtcattttcgtccgttccgtctcgcgttgccgtgcactgaaccaattgttgattgagcaaaatttcccctcaattgccatccatcgccaaatgccccaagaggaacgcctgggccgttatcaacaattcaaggatttccaaaagcgaattttggtggccacaaatttgttcggccgcggaatggacattgaacgcgtcaacattgtgttcaactatgatatgcccgaagacacggacacctatctgcatcgagtngcacgtgctggtcgtttcggcaccaaagggcttgccatcacatttgtttcggacgaaaccgatgcgcaaacattgaacagcgtccaggatcgtttcgatgtgaccattgctgaacttcctgaccaaattgatgttggaagctacnnnnnnnnnnnnnnnnnnnnn

SEQ ID NO: 572 - DNA, 963 bp, Artificial Sequence
  Description of Artificial Sequence: Synthetic polynucleotide
  modified_base (1)..(138): a, c, t, g, unknown or other
  modified_base (291)..(291): a, c, t, g, unknown or other
  modified_base (388)..(390): a, c, t, g, unknown or other
  modified_base (414)..(414): a, c, t, g, unknown or other
  modified_base (447)..(447): a, c, t, g, unknown or other
  modified_base (460)..(460): a, c, t, g, unknown or other
  modified_base (525)..(525): a, c, t, g, unknown or other
  modified_base (528)..(528): a, c, t, g, unknown or other
  modified_base (541)..(541): a, c, t, g, unknown or other
  modified_base (546)..(546): a, c, t, g, unknown or other
  modified_base (558)..(558): a, c, t, g, unknown or other
  modified_base (609)..(609): a, c, t, g, unknown or other
  modified_base (612)..(612): a, c, t, g, unknown or other
  modified_base (622)..(963): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtggatcgaggaatggaattgcgttttattggcggcatttacggtggaaatattaaaccaacgccatttctttgtcttacactcaaattattgcaacttcaaccggaaaaggacattataattgaatttattcggcaagatgatttcaantatattagagcattgggcgcaatgtatattcgattaacattcaattcggtggaagtttacaaatatttggaaccactctacaatgattatcgcaaannncgttatatgaatcgaatgggaagnatttgaataatccatatggatgaactcatcganaatttactccgtnatgaacactattgcgacattcaacttcctcgattacagaaacgtgaagcattggaagaaacggancanttggaattgtacnaatcngcattggatgangatttggaacaattgtcgagcagtgattcggaggatgaacgcgataaacgncgngaaaagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 573 - DNA, 2652 bp, Artificial Sequence
  Description of Artificial Sequence: Synthetic polynucleotide
  modified_base (1)..(117): a, c, t, g, unknown or other
  modified_base (351)..(351): a, c, t, g, unknown or other
  modified_base (448)..(1182): a, c, t, g, unknown or other
  modified_base (1405)..(1407): a, c, t, g, unknown or other
  modified_base (1480)..(1480): a, c, t, g, unknown or other
  modified_base (1690)..(1866): a, c, t, g, unknown or other
  modified_base (2041)..(2652): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagggcattcaacgaaacaccagtgaatccaaggaaatgccgcccaattctctgcaaacttctctatttactgcaacatggcgaaacaattgggaagaccgaggccactgacacattcttcgcaatcacaaaattatggcaagcaaaggatgtgacattgcggatgctggtttacctggcaatcaaggaattgtgcaacatttcaagtgatgtaataattgttactagcagnttaaccaaggatatgactggccgtgaagatatttaccggccatcagcaatccgggccctttgccgaattactgacacgggcatgcttcaggccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatccgctacccacgaaaacatgcaactttgatgaacttccttgcctcaatgcttcgcgatgaaggcggattcgagtacaaaaaggcaattgtggacaccataatcacaataattgaggacaatccggccgcaaaagatttgggcctttctcatctttgcgaattcatcgaggactgtgaacatgcggcattggccactcgagtgttgcatttgctggccnnngaaggacccaccacaaacaatcctgctcgctacattcgcttcatttacaatcgcgtcatattggaaacaacanaggttagagcagcggcggtcacagccttggccaaattcggtgccgaatgtgcccaactccgtccgagcataatgattttgctgaaacgatgcctgctggacacggatgatgaagtgcgcgaccgggccacattttatttgtccattttgagaagtgatgacaaaaatgcaatcgtcaaatacattttggacacactcaaggtttttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatttctgcaattccagaatttgcccacattggtccattggtcaaatcctctccaacatttgatttaaccgaggccgttacggaatacaatgtttcgtgcattcaacacgttttcaacgaacatttgttgttgcagtttgattgccgtaatacactgaatgaccaattgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 574 - DNA, 636 bp, Artificial Sequence
  Description of Artificial Sequence: Synthetic polynucleotide
  modified_base (1)..(162): a, c, t, g, unknown or other
  modified_base (337)..(423): a, c, t, g, unknown or other
  modified_base (508)..(636): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgatgggaaaacggtgaaagctcaaatttgggacacggcaggccaggaacgctatcgagccatcacatcggcatattatcgaggggcggttggcgcattgttggtctacgacattgcaaagcacgtcacctatgagaatgttgaacgttggcttaaaggtttgcgaaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnntatgccgaacgaaatcaactctcattcattgagacatccgccctggattcgaccaatgtggaggcggcattcaccaacattctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 575 - DNA, 2895 bp, Artificial Sequence
  Description of Artificial Sequence: Synthetic polynucleotide
  modified_base (1)..(879): a, c, t, g, unknown or other
  modified_base (994)..(994): a, c, t, g, unknown or other
  modified_base (1005)..(1005): a, c, t, g, unknown or other
  modified_base (1014)..(1014): a, c, t, g, unknown or other
  modified_base (1032)..(1033): a, c, t, g, unknown or other
  modified_base (1035)..(1036): a, c, t, g, unknown or other
  modified_base (1038)..(1038): a, c, t, g, unknown or other
  modified_base (1044)..(1044): a, c, t, g, unknown or other
  modified_base (1054)..(1056): a, c, t, g, unknown or other
  modified_base (1065)..(1065): a, c, t, g, unknown or other
  modified_base (1311)..(1311): a, c, t, g, unknown or other
  modified_base (1417)..(1605): a, c, t, g, unknown or other
  modified_base (2011)..(2064): a, c, t, g, unknown or other
  modified_base (2191)..(2736): a, c, t, g, unknown or other
  modified_base (2827)..(2895): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggatcaatccgctggcaaaacttccgtactcgaaatgattgctcaggccagaatatttccacgtggttccggtgaaatgatgactagggcgcctgtaaaggtcactctcagcnaaggtccatancatattgcncaatttcgtgacagtaanngnnantttganttgacaaaannncaagatctnagccaattgcgaaatgaaattgaatttcggatgaggaattcattgaaggatggaagaacagtctcaaatgaagtcatttcttaacggttaaagggtccatctttgcccagaatggttttagttgatttacccggaattatttcgacggtcacaacggacatggctttggaaaccaaagatgatattgccaaaatgtgcaaaacacatatggaaaatccaaatgccatcattttgtgcattcaagtnggttctgtggacgctgaacgcagcaatgtgactgatttagtgacaaatgttgatccaaatggccaaagaacaattcttgttttgacaaaagtggacttggcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcaaatgaccacccggaatatgtcaatggccgtgtccgattgtttttggcgaatggtgagggaatcaatcgaaactcagtcggacgcattcagagcgagtcgatttaatttggaaacggaatggaagaacacatttatgcaccaaagggatttgaccagggatgaactctttgaaaaggcaagaagtgaaatattggacgaagttgtcagtttgtcgcaagtcagcgccgatgaatgggaacaaatgttacggataaatttgtggaattcaatttcctctcaagtttttgatcaaattttaatgccggcctcctcatcggacaatgccggaacattcaacacattaatcgacattaaattgaaacattgggccgaaaaggaattggcaaataaatcaatacagnnnnnnnnnnnnnnnnnnnnnnnnnnnnnnnnnnnnnnnnnnnnnnnnnnnnnnaagagacgtgccgaaagggaagatttattggcgccattgaaaaatgccgtcgttgagacggccatttccgaacatgattgggacccaaaagcattggattatctccgagttattcaattgaatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaggaaatattaaatgattggtcccaggataatgagaagaagaaacaatatttgaccggaagacaagttgaattggcagaagaattgnnnnnnnnnnnnnnnnnnnnnnnnnnnnnnnnnnnnnnnnnnnnnnnnnnnnnnnnnnnnnnnnnnnnn

SEQ ID NO: 576 - DNA, 570 bp, Artificial Sequence
  Description of Artificial Sequence: Synthetic polynucleotide
  modified_base (187)..(570): a, c, t, g, unknown or other
atgaaagttattgagtcaagcgacactgttaaatttccggataatgtgaaattcgtcctgaagaatcgttcggttaaagttattgggccgcgtggaacactcaccagagacttccatcatctcaacattgaaattgcacaagagggacaaaaaacacttcgaattcgcaaatggttcggcatccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 577 - DNA, 3465 bp, Artificial Sequence
  Description of Artificial Sequence: Synthetic polynucleotide
  modified_base (1)..(231): a, c, t, g, unknown or other
  modified_base (348)..(348): a, c, t, g, unknown or other
  modified_base (493)..(495): a, c, t, g, unknown or other
  modified_base (543)..(543): a, c, t, g, unknown or other
  modified_base (625)..(1173): a, c, t, g, unknown or other
  modified_base (1329)..(1329): a, c, t, g, unknown or other
  modified_base (1525)..(1782): a, c, t, g, unknown or other
  modified_base (2218)..(2220): a, c, t, g, unknown or other
  modified_base (2334)..(2334): a, c, t, g, unknown or other
  modified_base (2527)..(2727): a, c, t, g, unknown or other
  modified_base (2805)..(2805): a, c, t, g, unknown or other
  modified_base (2862)..(2862): a, c, t, g, unknown or other
  modified_base (3118)..(3348): a, c, t, g, unknown or other
  modified_base (3463)..(3465): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatacaacgatatcaatgttggaatgccatcgagtgaagagggatttaatattctcaatgagaagattacgccacatgaatgcaggttgcgcgacatgacttattcagcaccaatntaatgtagtgttgaatacactcgaggtaatcaaaaggtcattaaaaacaacattatgattggtcgaatgccgataatgttgtcttcccgttgcattttatctcgattgacaacagaggaagagatggcccacgtgaatgaatgtnnntatgatcctggtggatattttattgtacgtgggacggaaaaggttgtnttgatgcacgaacaaaattcaaaaaatcggataatgataaatagaaatatgaagaaggaattatattgtgaagtgatgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattcaatgcggaattgaagaggattgcggacagccatttacaaaagaatttggcagctccacttgacattgttcgacatatgagacaagatttaattacaaatggtttgatccatgcgctttcaaccgggaattggtcaattcgtcgattcggnatggatcgccatggcgtcacccaagtcctctctcgtctttcatatatcagtgttttgggcatgatgacacgcataaattccacatttgagaggtcaagaaaagtgtccggtcccagatcgcttcaagcatctcaatgggttaatttggattttaaagatactccggaaggcgaagcctgcggtttggtgaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatttatttgaccagcgacggtggcagactgtgcaggccgtatataattgtggagaatggaacatcttgtctcagccaaaatcaaattgaagacgtgaaaaacggcacaaaaacattcgatgatttggtcagcgatggagccattgaattcttggacgtaaatgaaatgaacagttcaatgattgccgtttatgagcatcaaattccgccacaaacaactcatcttgagattgaaccattcactctgctcggcgtcgtctccggcctcattccctatcctcatcataatcagagtccccgtaacacatatcaatgcgcaatgggaaagcaggcgatgggcacaattggctataatcaacagaagaggattgacacgcttatgtatttgctcgtttatccccaaaaaccattggtcaaaacgaaaacaattgaannntcgaattttgagaaattgccagctggacaaaatgccattgttgcggtcatgtccttcagtggatacgacattgaggatgcattggtgttgaacaaggcttcattggatagaganttcggacgatgcatggtttatagatatgtgaaagggacggcaaggaaatatccaaatcaaacttatgacaaattcatgggcccttcgctggatgcggtcacccggaggccaattgcaaaacatgcagtgctcgataatgagggaatcgtgttcgccggtgcaaaaattcaaccaaaacaagtttaaattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgtcctgaaataggcgataaattcagcagccggcatggccaaaaaggcgtttgtggtttgatttcaccgcaagangacatgccattcgacaatttgggaatggtcccagatttgattatgaatccgcatggntatccgagtcgaatgaccgttggaaaattgatggaattaatttcgggaaaaaacgcattgatgggcgcaaggctccactatgggacagcatttggcggggatgatatggacacagtgaccaaacagttggctgcacatggattcaattggttgggcaaggatatgctcacatcgggaataaccggacagcaaatggaggcgtacatttattttggcccaatttattaccagaaattgaagcatatggttttggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcgtccgcttcaatggccaaaattaaaatcccatatgcttgcaaactccttttccaagagcttcaaagtatgagcatcgtgccacgattgatcacctccaaatatacggatnnn

SEQ ID NO: 578 - DNA, 957 bp, Artificial Sequence
  Description of Artificial Sequence: Synthetic polynucleotide
  modified_base (1)..(15): a, c, t, g, unknown or other
  modified_base (301)..(336): a, c, t, g, unknown or other
  modified_base (607)..(789): a, c, t, g, unknown or other
  modified_base (910)..(912): a, c, t, g, unknown or other
  modified_base (955)..(957): a, c, t, g, unknown or other
nnnnnnnnnnnnnnnccgcgcggggaaataatcagccgggaattcatcaaagagctggacgaatggattgcccaattgtatgaatgcaaacagctgggcgagaatcaagtcaaacaactttgcgacaaggcccgtgaaatcctaaaacaagagtccaatgtgcaagaggtgaaatgtccggtgactgtttgcggcgatgtgcacggccaattccacgatttgatggagctgttcaaaatgggtggaaaatcgccggacacgaattatctcttcatgggcgactacgtcgatcgaggctatnnnnnnnnnnnnnnnnnnnnnnnnnnnnnnnnnnnncaggttcgttaccgtgaccgagtgacaattttgcgaggaaaccacgagtcgcggcaaatcacccaagtttatggattttacgatgaatgtttacggaaatatggcaattcaaaagtttggaattatttcaccgatttattcgactacttcccgctgaccgccctcgttgatggccaaattttctgtttgcacggcggcctttcgcccagcatcgacaccctggaccatattcgatcattggagcgcttgcaggaagtaccacatgaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtggtgaccgtgttctccgcgcccaactattgctatcgatgtgggaatcaggcggcaatggtggagctggacgacgagctgaaatattccttccttcaatttgacccggcaccgcgtnnnggcgaaccgcatgtgacccgtcgaacaccggactatttcctcnnn

SEQ ID NO: 579 - DNA, 5277 bp, Artificial Sequence
  Description of Artificial Sequence: Synthetic polynucleotide
  modified_base (1)..(120): a, c, t, g, unknown or other
  modified_base (157)..(158): a, c, t, g, unknown or other
  modified_base (162)..(162): a, c, t, g, unknown or other
  modified_base (164)..(165): a, c, t, g, unknown or other
  modified_base (168)..(168): a, c, t, g, unknown or other
  modified_base (173)..(173): a, c, t, g, unknown or other
  modified_base (175)..(175): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(190): a, c, t, g, unknown or other
  modified_base (195)..(195): a, c, t, g, unknown or other
  modified_base (199)..(200): a, c, t, g, unknown or other
  modified_base (208)..(208): a, c, t, g, unknown or other
  modified_base (210)..(212): a, c, t, g, unknown or other
  modified_base (216)..(218): a, c, t, g, unknown or other
  modified_base (220)..(220): a, c, t, g, unknown or other
  modified_base (231)..(231): a, c, t, g, unknown or other
  modified_base (237)..(237): a, c, t, g, unknown or other
  modified_base (249)..(249): a, c, t, g, unknown or other
  modified_base (252)..(252): a, c, t, g, unknown or other
  modified_base (257)..(258): a, c, t, g, unknown or other
  modified_base (264)..(264): a, c, t, g, unknown or other
  modified_base (271)..(272): a, c, t, g, unknown or other
  modified_base (277)..(277): a, c, t, g, unknown or other
  modified_base (279)..(279): a, c, t, g, unknown or other
  modified_base (288)..(289): a, c, t, g, unknown or other
  modified_base (309)..(309): a, c, t, g, unknown or other
  modified_base (320)..(320): a, c, t, g, unknown or other
  modified_base (324)..(324): a, c, t, g, unknown or other
  modified_base (333)..(334): a, c, t, g, unknown or other
  modified_base (336)..(336): a, c, t, g, unknown or other
  modified_base (343)..(343): a, c, t, g, unknown or other
  modified_base (352)..(352): a, c, t, g, unknown or other
  modified_base (354)..(354): a, c, t, g, unknown or other
  modified_base (360)..(360): a, c, t, g, unknown or other
  modified_base (370)..(370): a, c, t, g, unknown or other
  modified_base (384)..(384): a, c, t, g, unknown or other
  modified_base (393)..(393): a, c, t, g, unknown or other
  modified_base (438)..(438): a, c, t, g, unknown or other
  modified_base (441)..(441): a, c, t, g, unknown or other
  modified_base (468)..(468): a, c, t, g, unknown or other
  modified_base (480)..(480): a, c, t, g, unknown or other
  modified_base (502)..(503): a, c, t, g, unknown or other
  modified_base (516)..(516): a, c, t, g, unknown or other
  modified_base (521)..(521): a, c, t, g, unknown or other
  modified_base (530)..(531): a, c, t, g, unknown or other
  modified_base (538)..(538): a, c, t, g, unknown or other
  modified_base (543)..(543): a, c, t, g, unknown or other
  modified_base (555)..(555): a, c, t, g, unknown or other
  modified_base (567)..(567): a, c, t, g, unknown or other
  modified_base (575)..(576): a, c, t, g, unknown or other
  modified_base (582)..(582): a, c, t, g, unknown or other
  modified_base (586)..(586): a, c, t, g, unknown or other
  modified_base (594)..(594): a, c, t, g, unknown or other
  modified_base (614)..(614): a, c, t, g, unknown or other
  modified_base (619)..(620): a, c, t, g, unknown or other
  modified_base (622)..(625): a, c, t, g, unknown or other
  modified_base (627)..(634): a, c, t, g, unknown or other
  modified_base (636)..(636): a, c, t, g, unknown or other
  modified_base (640)..(642): a, c, t, g, unknown or other
  modified_base (646)..(651): a, c, t, g, unknown or other
  modified_base (654)..(662): a, c, t, g, unknown or other
  modified_base (664)..(666): a, c, t, g, unknown or other
  modified_base (697)..(699): a, c, t, g, unknown or other
  modified_base (741)..(741): a, c, t, g, unknown or other
  modified_base (743)..(743): a, c, t, g, unknown or other
  modified_base (751)..(755): a, c, t, g, unknown or other
  modified_base (759)..(761): a, c, t, g, unknown or other
  modified_base (765)..(765): a, c, t, g, unknown or other
  modified_base (769)..(769): a, c, t, g, unknown or other
  modified_base (771)..(771): a, c, t, g, unknown or other
  modified_base (777)..(778): a, c, t, g, unknown or other
  modified_base (787)..(789): a, c, t, g, unknown or other
  modified_base (792)..(792): a, c, t, g, unknown or other
  modified_base (796)..(798): a, c, t, g, unknown or other
  modified_base (805)..(805): a, c, t, g, unknown or other
  modified_base (817)..(817): a, c, t, g, unknown or other
  modified_base (822)..(822): a, c, t, g, unknown or other
  modified_base (825)..(825): a, c, t, g, unknown or other
  modified_base (837)..(837): a, c, t, g, unknown or other
  modified_base (851)..(851): a, c, t, g, unknown or other
  modified_base (864)..(864): a, c, t, g, unknown or other
  modified_base (881)..(882): a, c, t, g, unknown or other
  modified_base (918)..(918): a, c, t, g, unknown or other
  modified_base (922)..(922): a, c, t, g, unknown or other
  modified_base (931)..(931): a, c, t, g, unknown or other
  modified_base (934)..(934): a, c, t, g, unknown or other
  modified_base (942)..(942): a, c, t, g, unknown or other
  modified_base (945)..(945): a, c, t, g, unknown or other
  modified_base (949)..(949): a, c, t, g, unknown or other
  modified_base (951)..(951): a, c, t, g, unknown or other
  modified_base (954)..(954): a, c, t, g, unknown or other
  modified_base (957)..(957): a, c, t, g, unknown or other
  modified_base (967)..(968): a, c, t, g, unknown or other
  modified_base (1003)..(1004): a, c, t, g, unknown or other
  modified_base (1022)..(1023): a, c, t, g, unknown or other
  modified_base (1030)..(1030): a, c, t, g, unknown or other
  modified_base (1044)..(1044): a, c, t, g, unknown or other
  modified_base (1057)..(1057): a, c, t, g, unknown or other
  modified_base (1068)..(1068): a, c, t, g, unknown or other
  modified_base (1071)..(1071): a, c, t, g, unknown or other
  modified_base (1076)..(1076): a, c, t, g, unknown or other
  modified_base (1078)..(1078): a, c, t, g, unknown or other
  modified_base (1084)..(1084): a, c, t, g, unknown or other
  modified_base (1089)..(1089): a, c, t, g, unknown or other
  modified_base (1097)..(1097): a, c, t, g, unknown or other
  modified_base (1100)..(1100): a, c, t, g, unknown or other
  modified_base (1110)..(1110): a, c, t, g, unknown or other
  modified_base (1116)..(1116): a, c, t, g, unknown or other
  modified_base (1122)..(1123): a, c, t, g, unknown or other
  modified_base (1128)..(1128): a, c, t, g, unknown or other
  modified_base (1141)..(1141): a, c, t, g, unknown or other
  modified_base (1150)..(1150): a, c, t, g, unknown or other
  modified_base (1154)..(1154): a, c, t, g, unknown or other
  modified_base (1160)..(1160): a, c, t, g, unknown or other
  modified_base (1164)..(1164): a, c, t, g, unknown or other
  modified_base (1167)..(1167): a, c, t, g, unknown or other
  modified_base (1170)..(1170): a, c, t, g, unknown or other
  modified_base (1178)..(1178): a, c, t, g, unknown or other
  modified_base (1186)..(1186): a, c, t, g, unknown or other
  modified_base (1195)..(1195): a, c, t, g, unknown or other
  modified_base (1204)..(1204): a, c, t, g, unknown or other
  modified_base (1212)..(1212): a, c, t, g, unknown or other
  modified_base (1215)..(1215): a, c, t, g, unknown or other
  modified_base (1223)..(1223): a, c, t, g, unknown or other
  modified_base (1232)..(1232): a, c, t, g, unknown or other
  modified_base (1235)..(1235): a, c, t, g, unknown or other
  modified_base (1249)..(1249): a, c, t, g, unknown or other
  modified_base (1261)..(1261): a, c, t, g, unknown or other
  modified_base (1268)..(1268): a, c, t, g, unknown or other
  modified_base (1276)..(1276): a, c, t, g, unknown or other
  modified_base (1347)..(1347): a, c, t, g, unknown or other
  modified_base (1349)..(1349): a, c, t, g, unknown or other
  modified_base (1366)..(1366): a, c, t, g, unknown or other
  modified_base (1372)..(1372): a, c, t, g, unknown or other
  modified_base (1386)..(1386): a, c, t, g, unknown or other
  modified_base (1390)..(1390): a, c, t, g, unknown or other
  modified_base (1399)..(1399): a, c, t, g, unknown or other
  modified_base (1402)..(1402): a, c, t, g, unknown or other
  modified_base (1409)..(1409): a, c, t, g, unknown or other
  modified_base (1416)..(1416): a, c, t, g, unknown or other
  modified_base (1422)..(1422): a, c, t, g, unknown or other
  modified_base (1427)..(1427): a, c, t, g, unknown or other
  modified_base (1446)..(1446): a, c, t, g, unknown or other
  modified_base (1458)..(1458): a, c, t, g, unknown or other
  modified_base (1480)..(1480): a, c, t, g, unknown or other
  modified_base (1485)..(1485): a, c, t, g, unknown or other
  modified_base (1507)..(1507): a, c, t, g, unknown or other
  modified_base (1523)..(1523): a, c, t, g, unknown or other
  modified_base (1540)..(1540): a, c, t, g, unknown or other
  modified_base (1552)..(1552): a, c, t, g, unknown or other
  modified_base (1557)..(1557): a, c, t, g, unknown or other
  modified_base (1567)..(1567): a, c, t, g, unknown or other
  modified_base (1572)..(1572): a, c, t, g, unknown or other
  modified_base (1575)..(1575): a, c, t, g, unknown or other
  modified_base (1581)..(1581): a, c, t, g, unknown or other
  modified_base (1594)..(1594): a, c, t, g, unknown or other
  modified_base (1602)..(1602): a, c, t, g, unknown or other
  modified_base (1612)..(1612): a, c, t, g, unknown or other
  modified_base (1622)..(1622): a, c, t, g, unknown or other
  modified_base (1629)..(1629): a, c, t, g, unknown or other
  modified_base (1634)..(1635): a, c, t, g, unknown or other
  modified_base (1639)..(1639): a, c, t, g, unknown or other
  modified_base (1648)..(1648): a, c, t, g, unknown or other
  modified_base (1650)..(1651): a, c, t, g, unknown or other
  modified_base (1666)..(1666): a, c, t, g, unknown or other
  modified_base (1669)..(1669): a, c, t, g, unknown or other
  modified_base (1676)..(1676): a, c, t, g, unknown or other
  modified_base (1680)..(1680): a, c, t, g, unknown or other
  modified_base (1683)..(1683): a, c, t, g, unknown or other
  modified_base (1696)..(1696): a, c, t, g, unknown or other
  modified_base (1714)..(1714): a, c, t, g, unknown or other
  modified_base (1720)..(1722): a, c, t, g, unknown or other
  modified_base (1747)..(1747): a, c, t, g, unknown or other
  modified_base (1752)..(1752): a, c, t, g, unknown or other
  modified_base (1766)..(1766): a, c, t, g, unknown or other
  modified_base (1774)..(1774): a, c, t, g, unknown or other
  modified_base (1792)..(1792): a, c, t, g, unknown or other
  modified_base (1794)..(1794): a, c, t, g, unknown or other
  modified_base (1805)..(1805): a, c, t, g, unknown or other
  modified_base (1810)..(1810): a, c, t, g, unknown or other
  modified_base (1813)..(1813): a, c, t, g, unknown or other
  modified_base (1815)..(1815): a, c, t, g, unknown or other
  modified_base (1819)..(1819): a, c, t, g, unknown or other
  modified_base (1829)..(1829): a, c, t, g, unknown or other
  modified_base (1832)..(1832): a, c, t, g, unknown or other
  modified_base (1849)..(1849): a, c, t, g, unknown or other
  modified_base (1851)..(1851): a, c, t, g, unknown or other
  modified_base (1870)..(1870): a, c, t, g, unknown or other
  modified_base (1884)..(1884): a, c, t, g, unknown or other
  modified_base (1894)..(1894): a, c, t, g, unknown or other
  modified_base (1899)..(1899): a, c, t, g, unknown or other
  modified_base (1929)..(1930): a, c, t, g, unknown or other
  modified_base (1932)..(1932): a, c, t, g, unknown or other
  modified_base (1935)..(1935): a, c, t, g, unknown or other
  modified_base (1940)..(1940): a, c, t, g, unknown or other
  modified_base (1983)..(1983): a, c, t, g, unknown or other
  modified_base (1989)..(1989): a, c, t, g, unknown or other
  modified_base (1998)..(1998): a, c, t, g, unknown or other
  modified_base (2007)..(2007): a, c, t, g, unknown or other
  modified_base (2020)..(2020): a, c, t, g, unknown or other
  modified_base (2031)..(2031): a, c, t, g, unknown or other
  modified_base (2063)..(2063): a, c, t, g, unknown or other
  modified_base (2072)..(2072): a, c, t, g, unknown or other
  modified_base (2085)..(2085): a, c, t, g, unknown or other
  modified_base (2125)..(2125): a, c, t, g, unknown or other
  modified_base (2143)..(2143): a, c, t, g, unknown or other
  modified_base (2164)..(2165): a, c, t, g, unknown or other
  modified_base (2212)..(2212): a, c, t, g, unknown or other
  modified_base (2220)..(2220): a, c, t, g, unknown or other
  modified_base (2257)..(2257): a, c, t, g, unknown or other
  modified_base (2275)..(2275): a, c, t, g, unknown or other
  modified_base (2284)..(2284): a, c, t, g, unknown or other
  modified_base (2286)..(2286): a, c, t, g, unknown or other
  modified_base (2307)..(2307): a, c, t, g, unknown or other
  modified_base (2311)..(2312): a, c, t, g, unknown or other
  modified_base (2341)..(2342): a, c, t, g, unknown or other
  modified_base (2347)..(2347): a, c, t, g, unknown or other
  modified_base (2356)..(2356): a, c, t, g, unknown or other
  modified_base (2361)..(2361): a, c, t, g, unknown or other
  modified_base (2379)..(2379): a, c, t, g, unknown or other
  modified_base (2404)..(2404): a, c, t, g, unknown or other
  modified_base (2406)..(2406): a, c, t, g, unknown or other
  modified_base (2433)..(2433): a, c, t, g, unknown or other
  modified_base (2440)..(2440): a, c, t, g, unknown or other
  modified_base (2448)..(2448): a, c, t, g, unknown or other
  modified_base (2455)..(2455): a, c, t, g, unknown or other
  modified_base (2469)..(2469): a, c, t, g, unknown or other
  modified_base (2480)..(2480): a, c, t, g, unknown or other
  modified_base (2497)..(2497): a, c, t, g, unknown or other
  modified_base (2520)..(2520): a, c, t, g, unknown or other
  modified_base (2529)..(2529): a, c, t, g, unknown or other
  modified_base (2534)..(2534): a, c, t, g, unknown or other
  modified_base (2538)..(2538): a, c, t, g, unknown or other
  modified_base (2541)..(2541): a, c, t, g, unknown or other
  modified_base (2551)..(2551): a, c, t, g, unknown or other
  modified_base (2568)..(2568): a, c, t, g, unknown or other
  modified_base (2582)..(2582): a, c, t, g, unknown or other
  modified_base (2586)..(2586): a, c, t, g, unknown or other
  modified_base (2598)..(2598): a, c, t, g, unknown or other
  modified_base (2605)..(2605): a, c, t, g, unknown or other
  modified_base (2658)..(2658): a, c, t, g, unknown or other
  modified_base (2668)..(2668): a, c, t, g, unknown or other
  modified_base (2672)..(2672): a, c, t, g, unknown or other
  modified_base (2677)..(2677): a, c, t, g, unknown or other
  modified_base (2682)..(2682): a, c, t, g, unknown or other
  modified_base (2696)..(2696): a, c, t, g, unknown or other
  modified_base (2700)..(2700): a, c, t, g, unknown or other
  modified_base (2706)..(2706): a, c, t, g, unknown or other
  modified_base (2754)..(2754): a, c, t, g, unknown or other
  modified_base (2777)..(2777): a, c, t, g, unknown or other
  modified_base (2784)..(2784): a, c, t, g, unknown or other
  modified_base (2803)..(2803): a, c, t, g, unknown or other
  modified_base (2843)..(2843): a, c, t, g, unknown or other
  modified_base (2865)..(2865): a, c, t, g, unknown or other
  modified_base (2898)..(2898): a, c, t, g, unknown or other
  modified_base (2956)..(2957): a, c, t, g, unknown or other
  modified_base (2973)..(2973): a, c, t, g, unknown or other
  modified_base (2988)..(2988): a, c, t, g, unknown or other
  modified_base (2991)..(2991): a, c, t, g, unknown or other
  modified_base (2997)..(2997): a, c, t, g, unknown or other
  modified_base (3010)..(3010): a, c, t, g, unknown or other
  modified_base (3021)..(3021): a, c, t, g, unknown or other
  modified_base (3037)..(3037): a, c, t, g, unknown or other
  modified_base (3040)..(3040): a, c, t, g, unknown or other
  modified_base (3051)..(3051): a, c, t, g, unknown or other
  modified_base (3065)..(3065): a, c, t, g, unknown or other
  modified_base (3087)..(3087): a, c, t, g, unknown or other
  modified_base (3092)..(3092): a, c, t, g, unknown or other
  modified_base (3112)..(3112): a, c, t, g, unknown or other
  modified_base (3119)..(3119): a, c, t, g, unknown or other
  modified_base (3144)..(3144): a, c, t, g, unknown or other
  modified_base (3149)..(3149): a, c, t, g, unknown or other
  modified_base (3154)..(3154): a, c, t, g, unknown or other
  modified_base (3159)..(3159): a, c, t, g, unknown or other
  modified_base (3162)..(3162): a, c, t, g, unknown or other
  modified_base (3177)..(3177): a, c, t, g, unknown or other
  modified_base (3219)..(3219): a, c, t, g, unknown or other
  modified_base (3231)..(3232): a, c, t, g, unknown or other
  modified_base (3241)..(3241): a, c, t, g, unknown or other
  modified_base (3264)..(3264): a, c, t, g, unknown or other
  modified_base (3267)..(3267): a, c, t, g, unknown or other
  modified_base (3273)..(3273): a, c, t, g, unknown or other
  modified_base (3276)..(3276): a, c, t, g, unknown or other
  modified_base (3278)..(3278): a, c, t, g, unknown or other
  modified_base (3282)..(3282): a, c, t, g, unknown or other
  modified_base (3315)..(3315): a, c, t, g, unknown or other
  modified_base (3325)..(3325): a, c, t, g, unknown or other
  modified_base (3350)..(3350): a, c, t, g, unknown or other
  modified_base (3354)..(3354): a, c, t, g, unknown or other
  modified_base (3376)..(3376): a, c, t, g, unknown or other
  modified_base (3384)..(3384): a, c, t, g, unknown or other
  modified_base (3387)..(3387): a, c, t, g, unknown or other
  modified_base (3390)..(3390): a, c, t, g, unknown or other
  modified_base (3429)..(3429): a, c, t, g, unknown or other
  modified_base (3439)..(3439): a, c, t, g, unknown or other
  modified_base (3442)..(3442): a, c, t, g, unknown or other
  modified_base (3448)..(3448): a, c, t, g, unknown or other
  modified_base (3502)..(3502): a, c, t, g, unknown or other
  modified_base (3547)..(3547): a, c, t, g, unknown or other
  modified_base (3552)..(3552): a, c, t, g, unknown or other
  modified_base (3566)..(3567): a, c, t, g, unknown or other
  modified_base (3570)..(3570): a, c, t, g, unknown or other
  modified_base (3600)..(3600): a, c, t, g, unknown or other
  modified_base (3605)..(3605): a, c, t, g, unknown or other
  modified_base (3610)..(3610): a, c, t, g, unknown or other
  modified_base (3615)..(3615): a, c, t, g, unknown or other
  modified_base (3637)..(3637): a, c, t, g, unknown or other
  modified_base (3642)..(3642): a, c, t, g, unknown or other
  modified_base (3646)..(3646): a, c, t, g, unknown or other
  modified_base (3660)..(3660): a, c, t, g, unknown or other
  modified_base (3664)..(3665): a, c, t, g, unknown or other
  modified_base (3668)..(3669): a, c, t, g, unknown or other
  modified_base (3673)..(3673): a, c, t, g, unknown or other
  modified_base (3675)..(3675): a, c, t, g, unknown or other
  modified_base (3678)..(3678): a, c, t, g, unknown or other
  modified_base (3682)..(3682): a, c, t, g, unknown or other
  modified_base (3687)..(3687): a, c, t, g, unknown or other
  modified_base (3691)..(3691): a, c, t, g, unknown or other
  modified_base (3710)..(3710): a, c, t, g, unknown or other
  modified_base (3714)..(3714): a, c, t, g, unknown or other
  modified_base (3718)..(3718): a, c, t, g, unknown or other
  modified_base (3735)..(3735): a, c, t, g, unknown or other
  modified_base (3741)..(3741): a, c, t, g, unknown or other
  modified_base (3744)..(3744): a, c, t, g, unknown or other
  modified_base (3758)..(3758): a, c, t, g, unknown or other
  modified_base (3784)..(3784): a, c, t, g, unknown or other
  modified_base (3791)..(3791): a, c, t, g, unknown or other
  modified_base (3804)..(3805): a, c, t, g, unknown or other
  modified_base (3807)..(3807): a, c, t, g, unknown or other
  modified_base (3814)..(3814): a, c, t, g, unknown or other
  modified_base (3819)..(3819): a, c, t, g, unknown or other
  modified_base (3828)..(3828): a, c, t, g, unknown or other
  modified_base (3877)..(3878): a, c, t, g, unknown or other
  modified_base (3888)..(3889): a, c, t, g, unknown or other
  modified_base (3921)..(3921): a, c, t, g, unknown or other
  modified_base (3926)..(3926): a, c, t, g, unknown or other
  modified_base (3934)..(3934): a, c, t, g, unknown or other
  modified_base (3942)..(3942): a, c, t, g, unknown or other
  modified_base (3990)..(3990): a, c, t, g, unknown or other
  modified_base (4014)..(4014): a, c, t, g, unknown or other
  modified_base (4017)..(4017): a, c, t, g, unknown or other
  modified_base (4023)..(4023): a, c, t, g, unknown or other
  modified_base (4026)..(4026): a, c, t, g, unknown or other
  modified_base (4034)..(4034): a, c, t, g, unknown or other
  modified_base (4044)..(4044): a, c, t, g, unknown or other
  modified_base (4049)..(4049): a, c, t, g, unknown or other
  modified_base (4057)..(4057): a, c, t, g, unknown or other
  modified_base (4116)..(4116): a, c, t, g, unknown or other
  modified_base (4129)..(4129): a, c, t, g, unknown or other
  modified_base (4143)..(4143): a, c, t, g, unknown or other
  modified_base (4179)..(4179): a, c, t, g, unknown or other
  modified_base (4192)..(4192): a, c, t, g, unknown or other
  modified_base (4197)..(4197): a, c, t, g, unknown or other
  modified_base (4209)..(4209): a, c, t, g, unknown or other
  modified_base (4227)..(4227): a, c, t, g, unknown or other
  modified_base (4230)..(4230): a, c, t, g, unknown or other
  modified_base (4242)..(4242): a, c, t, g, unknown or other
  modified_base (4249)..(4249): a, c, t, g, unknown or other
  modified_base (4260)..(4260): a, c, t, g, unknown or other
  modified_base (4264)..(4264): a, c, t, g, unknown or other
  modified_base (4291)..(4291): a, c, t, g, unknown or other
  modified_base (4315)..(4315): a, c, t, g, unknown or other
  modified_base (4320)..(4320): a, c, t, g, unknown or other
  modified_base (4327)..(4328): a, c, t, g, unknown or other
  modified_base (4334)..(4334): a, c, t, g, unknown or other
  modified_base (4365)..(4365): a, c, t, g, unknown or other
  modified_base (4373)..(4373): a, c, t, g, unknown or other
  modified_base (4383)..(4383): a, c, t, g, unknown or other
  modified_base (4388)..(4389): a, c, t, g, unknown or other
  modified_base (4392)..(4392): a, c, t, g, unknown or other
  modified_base (4408)..(4408): a, c, t, g, unknown or other
  modified_base (4416)..(4416): a, c, t, g, unknown or other
  modified_base (4428)..(4428): a, c, t, g, unknown or other
  modified_base (4477)..(4477): a, c, t, g, unknown or other
  modified_base (4479)..(4479): a, c, t, g, unknown or other
  modified_base (4487)..(4487): a, c, t, g, unknown or other
  modified_base (4489)..(4489): a, c, t, g, unknown or other
  modified_base (4495)..(4497): a, c, t, g, unknown or other
  modified_base (4500)..(4500): a, c, t, g, unknown or other
  modified_base (4515)..(4515): a, c, t, g, unknown or other
  modified_base (4527)..(4527): a, c, t, g, unknown or other
  modified_base (4532)..(4533): a, c, t, g, unknown or other
  modified_base (4535)..(4535): a, c, t, g, unknown or other
  modified_base (4539)..(4540): a, c, t, g, unknown or other
  modified_base (4543)..(4544): a, c, t, g, unknown or other
  modified_base (4548)..(4548): a, c, t, g, unknown or other
  modified_base (4550)..(4550): a, c, t, g, unknown or other
  modified_base (4558)..(4559): a, c, t, g, unknown or other
  modified_base (4569)..(4569): a, c, t, g, unknown or other
  modified_base (4576)..(4576): a, c, t, g, unknown or other
  modified_base (4579)..(4579): a, c, t, g, unknown or other
  modified_base (4593)..(4593): a, c, t, g, unknown or other
  modified_base (4722)..(4722): a, c, t, g, unknown or other
  modified_base (4771)..(5277): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggcgtgcccggtttcccaggagtcaaaggcgaanntggntnnccnggacnancnggnttnccnggnnttccnggannaaaaggcnannntggnnntnagggtgaaccnggactncccggattaccnggnatgannggaatnaaaggannagatngntcaattggnntgcccggagtaccaggcaanaaaggactaantggntttcctggnncncctgganttccaggantnccaggngtacaaggcnatcctggatcaccnggctatccnggcattccaggaataccaggattgcctggcctgccaggctaaccnggnccacctggaataccaggaataccgggngaaccaggatanggatatccaggatttcctggannacctggtgaaccnggaanaccaggctnncctggcntgccnggacaagaaggnttacctggactncccggagnnccaggnaatnctggattncctggaatacctggagaacnaggannannnngnnnnnnnngnatgnnnggannnnnnggnnnnnnnnnannnggttatccgggcttgcctggaccacaaggtnnnactggcgtgcccggtttcccaggagtcaaaggcgaacctggntncccaggannnnnaggnnnaccnggcntnccaggnnaaccaggannnccnggannnccggganaaccaggacaancaggnttnccaggcctaccnggagtaaaaggcgnacctggcttgccnggaataccaggagaacnnggattacctggactaccaggagaaccaggatatccnggantaccagganaanctggatanccnggcntnccnggncaacatggannacccggaataccaggaatgcccggaattccaggannaaaaggcgaatctggatnnccaggantaccaggaaaaaanggattacccggcnttcctggattnccnggaanancaagantaaancaaggccnacntggaccaccnggcttnacaggnnaaccnggaattccagganttccaggantacntggctnaccnggnttnccaggagnaccaggcntaccagganaaccagganatccaggnttnccaggacnaccaggagnacntggcttacctggantaccaggagaanaaggatnacctgganttccgggcctacctggagaaccaggaaaagccggcttgcccggaataccaggatcaaaaggcgaacctggnantccaggagaaccagganaaggantacccggaataccngganaaaaagganaanccggctntcctggnctaccnggagnaccaggataaaaaggactncccggaataccnggattaccaggcgaatcaattnctggnttgcctggagtacccggaaaanatggggtaacaggccnaccaggctacccagganaagccggaatanctggnctgcccggantaccnggntttaanggcgaacctgganaagaaggntaagctggcntgcccggaanacccggngaaannggantacccggantnncgggctaacctgganaanaaggagnaccnggnctgcccggaattncaggaaaaaaaggcgaanctggannnccaggtttacctggactacaaggantaccnggcgatccaggaanacccgganaagctggcttgcctggantnccaggagtacnaggcnaananggangaaatggagntcnaccaggagtacccggantnccaggagtaaaaggcgaancaggataacctggncaaccaggantaccnggattaccaggaataccaggaaaagctggnnanccnggatnacctggactacccggaataccaggaaaaccaggactgccaggnttaccnggctaaccnggaaaaccnggactacccggantaccaggaatnaaaggagaaacaggatttggttaacctggaanacctggagnaccaggctaacanggacaagaaggattacccggattgccaggaataccaggantaccaggaataccagganaacctggaccaggtggacaanntgaaccaggaaaaccaggaaaagctggattgcctggaatgcctggancacaaggngaacctggaattccaggcttacctggcgaaccaggantacccggactacccggantacctggantnaaaggagaaactggattaccnggannaccaggaataccaggactaccaggagtannaggcnaaaaagganaaccnggactacccggattaccnggaataccaggataaaaaggagaancnggaaatcctggattaccaggactaccnggagtanaaggcaancccgganttggactacccggnttacctggagnaccaggactaccaggantaaaaggacaagcaggatttccnggaataccnggagnaccnggnttaccagganaaccaggagtacctggntttccaggaataanaggngaacctggattncccggantaccaggagaaccaggattacctggactaccaggagaacctggattacccggnttaccagganaaanagganaaccnggaataccaggacnaaanggcttncccggctttccaggaataaaaggagaagctggatttcccggactaccnggactaaaaggaataccaggacnaccaggnctacctggagtaccaggantacctggactacctggagtaccaggcttaccaggaatacnaggaaaacctggattaccaggnataccaggaataacaggaaaacctggattaccnggactaccaggattaccaggataacctggcgaacccggaataccaggagtaccaggannacctggattaccaggngaaccaggattaccnggnataccnggaaaaccaggantacccggcatnccaggaataaaagganaanctggattaccnggactacctggagnaaaaggaaaaactggataaacnggatnacctggactaccaggaaaanctggatnaccaggccttccaggattacaaggnaaacntgganaaccnggntttcctggaataccnggaataaaaggcgaacccggctttccaggaataggcgaaccnggactaccaggnntaacaggantacctggaatacccggattacanggngtaccnggngntccnggactaccaggagaagctggattacccggcttnccaggagtanaaggataacctggctttccaggacnaccnggagaaccaggactaccaggantacctggnatnccnggattaccaggagaacctggattaccaggattaccaggnttacctggantancagganaacctggactacctggaattcctggcgtaccaggataacaaggagaacctgganttcctggaataccaggagaaacaggcttacctggattaccaggantaaanggcgaagaaggatnnccnggcctacccggactaccaggaatacctggncaaanaggantaccnggatatccaggattacctgganaacanggcnaaccaggcaaaccnggannagnnggantnccnggcntgccnggantacaaggagaaactggctntccnggantaccaggaccaaaaggnttaccnggnttaccaggaaaaanaggaaaacctggatttcctggactanctggagnaccaggacaaggnntncctggantaaanggagaaccnggattacctggaataccaggaaaagaaggattacccggattacctggannaaaaggcgannctggattacctggattacctggagaaccaggnttacnaggccaancaggcttncctggatttccaggaatacctggaaaacctggatttccaggcttaccnggactacaaggagaacctggattnccnggaatnccnggataacnaggattaccnggcanacctggantaccaggagaacctggatttccaggaataccaggagaaccaggagtacctggcataccnggaataccagganaaccaggattaccnggattaccaggagtaaaaggcgaagctggatttccnggaataccaggantaccnggaatacctggncaacaaggagaaccaggnttnccaggaataccnggaaaanatggagtaccnggantaccaggaaaaccaggataacctggantaccaggactacaaggatttattnatccnggaaaanntggacnacctggattacctggattaccaggaataaanggaaaaanaggagtaccnggctnnccnggaatacccggaaaanatggattnccaggcataccnggaccaaaaggctatcctggctttccaggaatacccggaaaacctgggntncccggcgnancaggcnnnccnggaataccaggaatncatggcatgccnggagnncnaggnnaannaggnanaccaggannaccaggctanccaggancanccggaaaagatggnttcatcgtggtcacccattcccaaacaacccaagtgccaccatgtccccaaaatactcgacgcctttgggatggctattccctcctctatttggaaggcaatgaaaaggcgcataaccaggatttgganaatgccggctcatgtttgcctcgtttctccacaatgcctttcttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 580 - DNA, 1596 bp, Artificial Sequence
  Description of Artificial Sequence: Synthetic polynucleotide
  modified_base (1)..(399): a, c, t, g, unknown or other
  modified_base (577)..(792): a, c, t, g, unknown or other
  modified_base (1135)..(1188): a, c, t, g, unknown or other
  modified_base (1374)..(1374): a, c, t, g, unknown or other
  modified_base (1443)..(1443): a, c, t, g, unknown or other
  modified_base (1449)..(1449): a, c, t, g, unknown or other
  modified_base (1461)..(1461): a, c, t, g, unknown or other
  modified_base (1485)..(1485): a, c, t, g, unknown or other
  modified_base (1494)..(1494): a, c, t, g, unknown or other
  modified_base (1507)..(1596): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaatcgattgtggatgttttcggcactgtggccaaaacaccttcgcccgtttcgagttgcagccaaagtgatgtggaaattcgaatacaaaaattgttcatcgtttctgccgccgaaccccgacttcccctgcaaattgaggatgcttcacggccagagcaaaatcaggacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaggtcagctatttcaagggatcagcctatttggcccaatcgccgcaattgtacaaacaaatggccattgccggcgactttgaccgtgtgttcacggttggtgccgtttttcgtgccgaagacagtaacacccaccgacatttgaccgaatttgtgggacttgacctggaaatggccttcaaatttcattaccatgaggtgatgaacacaattgccgaaatgctcattgagctgttcaaaacactccaatcggaatatcaaccgaaagttgagaccattcgccgccaatatcacagcgagccattcctctacacggaaaaaccattcattttgcagtttnnnnnnnnnnnnnnnnnnnnnnnnnnnnnnnnnnnnnnnnnnnnnnnnnnnnnngatttgagcactccaaatgaaaaattgttgggccgaattgtgcgagaacgccatcaaaccgatttttacgtgctcgacaaattcccacttgccgttcgtccattctacacaatgccggatcccaaggatggcaaatactcgaacagctatgatatgttttatttaggtgaggaaatcctgtccggngcccaacgtgtccatgaccctgcacttttgacggaacgagcaaagttgcacaatattgatttggaaaanatcaangcctacgtggangcattcaaatatggctgcccaccncatgccggnggaggaattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 581 - DNA, 546 bp, Artificial Sequence
  Description of Artificial Sequence: Synthetic polynucleotide
  modified_base (46)..(48): a, c, t, g, unknown or other
  modified_base (118)..(222): a, c, t, g, unknown or other
  modified_base (261)..(261): a, c, t, g, unknown or other
  modified_base (538)..(546): a, c, t, g, unknown or other
atgggaaacgtctttgcaagcttgttcaaggggcttttgggaaagnnngaaatgcgcattttgatggtcggtttggacgctgctggaaaaaccacaattctctacaaactgaaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtccactttggaggtattacttccagaacacccaagtnctgatcttcgttgttgattcaaacgatcgagaacgtgtcggcgaagccagagaagaattgatgcgcatgctggccgaggacgaacttcgtgatgcagtccttcttgtttttgcaaacaaacaggatttgccaaatgccatgaatgccgcagaggtcaccgacaagcttggactccatacgttacgcaatcgcaattggtacattcaagcaacttgtgccacatcgggcgatggactctacgaaggacttgactggctgagcaatcaattgaagaatnnnnnnnnn

SEQ ID NO: 582 - DNA, 501 bp, Artificial Sequence
  Description of Artificial Sequence: Synthetic polynucleotide
  modified_base (114)..(114): a, c, t, g, unknown or other
  modified_base (309)..(309): a, c, t, g, unknown or other
  modified_base (412)..(501): a, c, t, g, unknown or other
atggctggaattgctgctggacgtcttgcggaggagcggaaggcatggcgaaaggatcatccattcggattcattgctcgaccgaccaaaaacgaagatggaacattaaatctnttcaactgggaatgtgcaattcctggtccaaagtcaacgatttgggaaggtggcctctacaaattgcgaatgatgttcaaggatgatttcccatcgacaccaccgaaatgtcgcttcgaaccacctcttttccacccgaatgtttacccttctggaacggtgtgccttagcctgttggacgagaataaggacggnaagccttccatttctatcaaacaattattggtcggcattcaagagttgttggtttcgccaaatcccgaggacccagcacaggccgaagcctatcaaatctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 583 - DNA, 1665 bp, Artificial Sequence
  Description of Artificial Sequence: Synthetic polynucleotide
  modified_base (1)..(351): a, c, t, g, unknown or other
  modified_base (424)..(426): a, c, t, g, unknown or other
  modified_base (628)..(1665): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaaaataccacgcagaccgaagcagggaacattcaaaaatgccaacgaattggatgcactcgaatcggaannntttttggaatggcgacgtaaattggccaaactttctgagggaagcggtgttgtaataactccattcgagcgtaatttggaaatatggcgtcaactttggcgtgtccttgagaggagtcatgttgtggttcagattgttgacgcacgaaatcctctgctcttcagaaatattgatttggaaagttatgtcaaggaaattgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 584 - DNA, 1311 bp, Artificial Sequence
  Description of Artificial Sequence: Synthetic polynucleotide
  modified_base (1)..(15): a, c, t, g, unknown or other
  modified_base (156)..(156): a, c, t, g, unknown or other
  modified_base (244)..(345): a, c, t, g, unknown or other
  modified_base (586)..(888): a, c, t, g, unknown or other
  modified_base (1111)..(1311): a, c, t, g, unknown or other
nnnnnnnnnnnnnnnaatcgaaatgtgcaagacccattctatcgttacaagatgccccgtattgttgcaaaagtggaaggcaagggaaatgggatcaagaccgtcatcgccaatatgcccgaaatagcaaaggcactttctcgtcctccaactttnccaaccaaatatttcggttgtgaactcggcgcccaaaccaactttgatctgaaaaatgagcgttacatcgtaaatggggagcatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccatgcaaaatgcaaagcgtgcggccacgtctaccaaattgatccgaagcaaaaattgtcgacctacattttgaagaatccgccgccacaggaagcagattcgaccgcaaaagggaccgaaaatggtggaacaccgccaggggaggaggtggcatcggccgttgcgaccgacaatggaaacaatcaacattcgggcggttcggtggatgaggacgacgacgattgggcaccggaaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccaacgctaccttctatatggaatcgaacaaaccgtggaggcaaacaaggatgttttgttagcaaaaagtgctcacattatcaaggccctctatgacaatgatttgtgtgaagaggaagtgcttttggaatgggaaaagaagccgagcggaaagtttgcgaagaagaatttcgtgaaggagatgatcgcggtggcccaaccggtgctgaattggctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 585 - DNA, 579 bp, Artificial Sequence
  Description of Artificial Sequence: Synthetic polynucleotide
  modified_base (166)..(279): a, c, t, g, unknown or other
  modified_base (442)..(579): a, c, t, g, unknown or other
atgtcaactccttcacgtcgccgtctgatgcgtgatttcaaaaaactgcaggatgatccgccaggtggagtcagtggggccccaacagaggaatcaataatgcgttgggaagcagtgatatttggaccacaagacaccccattcgaggatggaacattcaaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaatggtctcccacctatgatgtggccgccattctcacttcaattcaatcattgttggatgaacccaacccaaatagtccggcgaattcattggctgctcaactttatcaggagaatcgacgagaatatgagaaaagagttcatgccattgttgaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 586 - DNA, 639 bp, Artificial Sequence
  Description of Artificial Sequence: Synthetic polynucleotide
  modified_base (1)..(141): a, c, t, g, unknown or other
  modified_base (339)..(339): a, c, t, g, unknown or other
  modified_base (375)..(375): a, c, t, g, unknown or other
  modified_base (411)..(411): a, c, t, g, unknown or other
  modified_base (429)..(436): a, c, t, g, unknown or other
  modified_base (438)..(438): a, c, t, g, unknown or other
  modified_base (481)..(639): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataggaataaccgaagacagttatgaggacaattcaaaggcagcttacgaaatcttcgtcaaggatctcaaagacaagaccgatggctttcaggactgtcgttatgccgtgttcgacttcaaattccaaactcatcgtcccggggccggcacatcgaaaatggacaaaattgtctttatccagttatgcccagatggngcatcaatcaagaagaagatgttgtacgcttcgtcngcatccgcaataaaagcatcgctgggaaccgccaanattttgcaattccaagtnnnnnnnnantcagaaattgcgcacaaagaattgctgagcaagctcaacgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 587 - DNA, 552 bp, Artificial Sequence
  Description of Artificial Sequence: Synthetic polynucleotide
  modified_base (154)..(387): a, c, t, g, unknown or other
  modified_base (445)..(445): a, c, t, g, unknown or other
  modified_base (454)..(454): a, c, t, g, unknown or other
  modified_base (462)..(462): a, c, t, g, unknown or other
  modified_base (474)..(474): a, c, t, g, unknown or other
  modified_base (531)..(531): a, c, t, g, unknown or other
  modified_base (550)..(552): a, c, t, g, unknown or other
atggtgcgaaatttgaaattccatgagcggaaattgctgaagaaagttgacttcatccattgggaagtggacaatagtcttcatgagaacaaaattatgcggcgatatcatgtggagaagagggaacactacacaatatacaataaactttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgaacaaggccatattcgggttggcatcgaattggtcactgatccagcattccttnttacacgcnttcaatcngatgagatcacntgggcacgtcaatccaaaatcaaaggacatgtgcaaaaatataacaatgaaagagangattttgaaatggaagatnnn

SEQ ID NO: 588 - DNA, 1278 bp, Artificial Sequence
  Description of Artificial Sequence: Synthetic polynucleotide
  modified_base (1)..(612): a, c, t, g, unknown or other
  modified_base (694)..(828): a, c, t, g, unknown or other
  modified_base (1276)..(1278): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaccgatattcaaatgcataaggagtcaagatggtattccagttggaagtcattcgccgagtcaaatacttattttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagttgatccggcgttcagcaaacatgaatggttgcgtttttgtgaaaaagagttgattccgaacatcctggaagcatccattcaaatgaatttggaggttcttcaggattggtgccatgaaagagcattcactatgattgccactggaattaaggaatataagaaagtgggctttcacactttggattcacaaattatcgacgtcagcaaagttgagatggtcaccggtaaaatgatggaacaaggcccagcgttggtgatcacatttcaagtattcatgttgcatgtggtcaaaaacagtgagggcaaagtgatcgaaggcgacccgtacaacgcaattcgtgttcaccatgtttgggtactttgtcgcgatatggaggaattcaatccggcgacggcttggaaattgttggaattgcacgtgcaaaaaggaaatttagtgcttnnn

SEQ ID NO: 589 - DNA, 1470 bp, Artificial Sequence
  Description of Artificial Sequence: Synthetic polynucleotide
  modified_base (1)..(132): a, c, t, g, unknown or other
  modified_base (499)..(499): a, c, t, g, unknown or other
  modified_base (501)..(501): a, c, t, g, unknown or other
  modified_base (652)..(654): a, c, t, g, unknown or other
  modified_base (1038)..(1038): a, c, t, g, unknown or other
  modified_base (1249)..(1470): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttcaaatttcagaaaataaacaccgaattgtgcagcgcatgtgaacgcattggttggaaaaaaccgatgccaattcagcaaaagatcattccattagcacttgctggtaaagatgtgattggtttggccgaaactgggtctggcaaaactggtgctttcgctttgcccattctccaagcattgatggaaaatcctcaacgactttttgcggttgttctggccccaacccgggaattggccttccaaatttccgaacaatttgaagcacttggcgccacaattggccttcaagtttgtacaattgttggcggcattgatatgtccactcaaacattgtcgctttccaaacggccacatatcattntngcaacgcctggtcgtcttgtcgatcatctggaaaacaccaaaggcttcgatcttcgtccggtcaaatatttggtcatggacgaggccgaccgaattttgaacatggattttgaagtggaattggacaaaattttgaaagttattccaaaannnaggaaaacttatttgttttcggcgacaatgactcaaaaggtttccaaactggaaagagctcatttgaagaacccggcccgcgttgaattatcgtcaaaatatcaaaccgtgagcaccctcatccaaaacatgctattcatcccattcaaatataaggaagcctatttggtctatgtgctcaatgagaaggcggggaacaccgcaatagttttcgttgggacttgtgccagcgccgtcaaattggctttgatgcttcgacatttgggttttggtgccatcgcccttcatggacaaatgtcacaacctaaacggctgggcgcactgaacaaattcaaaaagaaggatcgacccattttggtctgcacggatgtcgcttccagaganttggacattccgcatgtggacatggtcctgaattatgatgttccggctcattccaaggattacgtgcatcgtgttggacgaacggcgagggctggaaagtctggcgtagcattgaccatgattacccaatacgacgtggaaatctaccaaaaagttgaaaattcccttggcaagaaattggacccaatggaagtgaaccatgaggaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 590 - DNA, 882 bp, Artificial Sequence
  Description of Artificial Sequence: Synthetic polynucleotide
  modified_base (409)..(417): a, c, t, g, unknown or other
  modified_base (472)..(540): a, c, t, g, unknown or other
  modified_base (598)..(600): a, c, t, g, unknown or other
  modified_base (624)..(624): a, c, t, g, unknown or other
  modified_base (715)..(882): a, c, t, g, unknown or other
atggctcttgttaaagttgttaaaaatcgtgcatatttcaaacgataccaaccaaaattcaaaaggcgtcgccagggaaagactgactattatgcacgaaaacgtctcacggtccaggataagaacaaatataacaccccgaaatatcgcctcattgttcgtttcaccaacaaggacattgttgcccagattgcctattcgcaaatccaaggcgacatgattgttaatgccgcctattcccatgagcttccgcgttatggaatcaagttgggtctgaccaattatgcggctgcttatgcgactggacttctccttgctcgtcgccatttgcaaaagcttaaaatggactcggcctacaaaggcaaagaaaatgcggatggcgaatatttcgatgtggaaggtgaaaacnnnnnnnnnccattcacatgtgttctcgacgttggccttgcccgtactacaaccggtgcaaaannnnnnnnnnnnnnnnnnnnnnnnnnnnnnnnnnnnnnnnnnnnnnnnnnnnnnnnnnnnnnnnnnnnnggttatgacaaggactcaaagaattataacgccgaagcacatcgagaccgatttttgnnncaacatgtttcggaatacatgaantacttgaaggaaaatgacgaggaaggttacaatcgccaattctcgaaattcgtcaaggaaggaattgcacccgaatcggtcaatcttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 591 - DNA, 1956 bp, Artificial Sequence
  Description of Artificial Sequence: Synthetic polynucleotide
  modified_base (1)..(174): a, c, t, g, unknown or other
  modified_base (204)..(204): a, c, t, g, unknown or other
  modified_base (442)..(1188): a, c, t, g, unknown or other
  modified_base (1276)..(1314): a, c, t, g, unknown or other
  modified_base (1323)..(1324): a, c, t, g, unknown or other
  modified_base (1329)..(1329): a, c, t, g, unknown or other
  modified_base (1335)..(1335): a, c, t, g, unknown or other
  modified_base (1359)..(1359): a, c, t, g, unknown or other
  modified_base (1363)..(1363): a, c, t, g, unknown or other
  modified_base (1386)..(1386): a, c, t, g, unknown or other
  modified_base (1402)..(1402): a, c, t, g, unknown or other
  modified_base (1407)..(1407): a, c, t, g, unknown or other
  modified_base (1437)..(1437): a, c, t, g, unknown or other
  modified_base (1446)..(1446): a, c, t, g, unknown or other
  modified_base (1450)..(1956): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaatgtacaaaaatttcaaaccagtcagngattcaaaaggcaaaatcatcaagtcggcaccatttcaaggaacattgcaatcgggcacagtggccagggttgagcctcatcgaaagtggtttggtaatacccgagtggttggtcaagaacaattgcaacgtttccaagaggaaatgggcaaagttttgcatgacccattccaagtggtgatgcgccaaacgagggcaccaatttcgctgttgcaggaaaaagccaaggtaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcgcgtcgaaaatgtgcccgatccagagaatcatattcaagcggttttggaccgatgtaggcccgaacatttgatgcgtcatttcnnnnnnnnnnnnnnnnnnnnnnnnnnnnnnnnnnnnnnnaagattgcnntggcntctggncgtttactgaagggtggggagccngacntgaacacggtggcccgacaaatnctcaacgactatcaangaggnaatattccacattttgtacttccaccgggntgcgaacancgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 592 - DNA, 3735 bp, Artificial Sequence
  Description of Artificial Sequence: Synthetic polynucleotide
  modified_base (73)..(78): a, c, t, g, unknown or other
  modified_base (223)..(339): a, c, t, g, unknown or other
  modified_base (538)..(3063): a, c, t, g, unknown or other
  modified_base (3283)..(3735): a, c, t, g, unknown or other
atgagaattaaaaagattgaaatcgaaggattcaaatcatattccaaaggggttgacgttcttgaccatcaannnnnnttcaatgcaatcactggcctaaatggttccggcaaatcgaatatattggatgcaatttgctttctacttggcatcacaaatttatcaaatgttcgagcacattcattcacggatctcgtctataaacaggggcaggcaggcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacttaccaaattaatggggtaaccgcaacaaaccagcgggtgactgatctattcaaaatggttggcatcaatgtgaacaatccgcactttcttattatgcaaggccgaataaccaaagtgttgaatatgaaaccgttagagatactttcaatggtggaagaagcggccggagtccgcatgtatgaatgcaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctggcaaaagacagaaaacaattattggaatcaatcgaacaattggatgtgaagaagaaacgtgaacttattgcggcacacaaacaaattagcaatgatttttgtgcaatttattcaacacttttgccgggcgcaagtgccgaattgcttccaccaaacggggaggagacttgcaatggattggaagttcgagtggcatttaatggaaaatataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 593 - DNA, 3081 bp, Artificial Sequence
  Description of Artificial Sequence: Synthetic polynucleotide
  modified_base (1)..(291): a, c, t, g, unknown or other
  modified_base (346)..(348): a, c, t, g, unknown or other
  modified_base (474)..(474): a, c, t, g, unknown or other
  modified_base (496)..(496): a, c, t, g, unknown or other
  modified_base (500)..(501): a, c, t, g, unknown or other
  modified_base (505)..(505): a, c, t, g, unknown or other
  modified_base (507)..(507): a, c, t, g, unknown or other
  modified_base (510)..(510): a, c, t, g, unknown or other
  modified_base (512)..(512): a, c, t, g, unknown or other
  modified_base (516)..(516): a, c, t, g, unknown or other
  modified_base (523)..(523): a, c, t, g, unknown or other
  modified_base (534)..(534): a, c, t, g, unknown or other
  modified_base (543)..(543): a, c, t, g, unknown or other
  modified_base (546)..(546): a, c, t, g, unknown or other
  modified_base (556)..(558): a, c, t, g, unknown or other
  modified_base (562)..(562): a, c, t, g, unknown or other
  modified_base (564)..(565): a, c, t, g, unknown or other
  modified_base (567)..(567): a, c, t, g, unknown or other
  modified_base (576)..(579): a, c, t, g, unknown or other
  modified_base (582)..(583): a, c, t, g, unknown or other
  modified_base (588)..(589): a, c, t, g, unknown or other
  modified_base (606)..(610): a, c, t, g, unknown or other
  modified_base (612)..(612): a, c, t, g, unknown or other
  modified_base (618)..(618): a, c, t, g, unknown or other
  modified_base (625)..(627): a, c, t, g, unknown or other
  modified_base (631)..(631): a, c, t, g, unknown or other
  modified_base (633)..(633): a, c, t, g, unknown or other
  modified_base (651)..(652): a, c, t, g, unknown or other
  modified_base (654)..(654): a, c, t, g, unknown or other
  modified_base (658)..(660): a, c, t, g, unknown or other
  modified_base (662)..(663): a, c, t, g, unknown or other
  modified_base (666)..(666): a, c, t, g, unknown or other
  modified_base (669)..(670): a, c, t, g, unknown or other
  modified_base (672)..(672): a, c, t, g, unknown or other
  modified_base (674)..(674): a, c, t, g, unknown or other
  modified_base (676)..(676): a, c, t, g, unknown or other
  modified_base (678)..(678): a, c, t, g, unknown or other
  modified_base (685)..(685): a, c, t, g, unknown or other
  modified_base (688)..(691): a, c, t, g, unknown or other
  modified_base (693)..(694): a, c, t, g, unknown or other
  modified_base (696)..(696): a, c, t, g, unknown or other
  modified_base (698)..(699): a, c, t, g, unknown or other
  modified_base (705)..(705): a, c, t, g, unknown or other
  modified_base (714)..(714): a, c, t, g, unknown or other
  modified_base (720)..(720): a, c, t, g, unknown or other
  modified_base (731)..(731): a, c, t, g, unknown or other
  modified_base (739)..(739): a, c, t, g, unknown or other
  modified_base (741)..(741): a, c, t, g, unknown or other
  modified_base (744)..(744): a, c, t, g, unknown or other
  modified_base (747)..(747): a, c, t, g, unknown or other
  modified_base (750)..(750): a, c, t, g, unknown or other
  modified_base (753)..(753): a, c, t, g, unknown or other
  modified_base (763)..(763): a, c, t, g, unknown or other
  modified_base (768)..(768): a, c, t, g, unknown or other
  modified_base (771)..(772): a, c, t, g, unknown or other
  modified_base (774)..(774): a, c, t, g, unknown or other
  modified_base (781)..(781): a, c, t, g, unknown or other
  modified_base (783)..(786): a, c, t, g, unknown or other
  modified_base (789)..(790): a, c, t, g, unknown or other
  modified_base (792)..(795): a, c, t, g, unknown or other
  modified_base (798)..(798): a, c, t, g, unknown or other
  modified_base (801)..(802): a, c, t, g, unknown or other
  modified_base (804)..(804): a, c, t, g, unknown or other
  modified_base (813)..(813): a, c, t, g, unknown or other
  modified_base (816)..(816): a, c, t, g, unknown or other
  modified_base (819)..(819): a, c, t, g, unknown or other
  modified_base (827)..(827): a, c, t, g, unknown or other
  modified_base (829)..(829): a, c, t, g, unknown or other
  modified_base (834)..(834): a, c, t, g, unknown or other
  modified_base (837)..(837): a, c, t, g, unknown or other
  modified_base (964)..(1227): a, c, t, g, unknown or other
  modified_base (1462)..(2568): a, c, t, g, unknown or other
  modified_base (2725)..(2763): a, c, t, g, unknown or other
  modified_base (2925)..(2925): a, c, t, g, unknown or other
  modified_base (3076)..(3081): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtctgcatgccatttgaccaagaatttgccccactcaaaataaacactgggnnnaaaccggcaaaggaatttccatttgagttggatccattccaaaaagcggccatttgttgcctcggcaattcccaatccgttctcgtttcggcccacacttttgctggcaaaacagttgtggcaatntatgcaatttcacttgcacttnaagnnaaanancgngncatntacacancaccaatcaangcgctcagnaancaaaaatacnnngaantnncngacgaattnnnngannttggnntgatgaccggcgatgtnnnnntnaatccnaatgcannntgcntngtgatgaccaccgaaatnntncgcnnnannctntanngngncncngaaattntgnnnnanntngnntgggtnatttttgangaaatncactatatgcnggacaaanancgnggngtngtntgggaagagncaatnatnntnttgccgnannnnacnnannnngtnttnntntcggccacnatnccnaatgccancnaattngcngaatggatttgttatttgcaccatcaaccgtgcaatgtggtctacacgaatatgcggcccgttcctctccagcatttgatttttccagccggtggcactggactttatgaagtcgttgatataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatttaaatgctttgaatttgttatcggaagaggacagaaaattgccccaaatccaaaatgtgcttccttttttggtgcgcggcattggcattcatcattctgggcagctgccaattatgaaggaaattgtggaaattctttttggcgaaggactcatcaagaccctttttgccactgaaacattcgcaatgggcgtgaacatgccggccaaaacggtgcttttcacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaagggtcgagtggcttgtgaactgagttcggccgatgaattgttgctgaccgaactcatttttgcgggcacattcagcaatttgaagccagaggaggccgcagccttgctcacttgttttgtttttgaggagagggcaccaaacacaaaaatcnnnnnnnnnnnnnnnnnnnnnnnnnnnnnnnnnnnnnnncatgctaaaaggattgcccaagtttgcacggaatcaaaattggaactgaacgaagagaaatacgttgaacaatttggagccggaatgatcgatgtggtctacaaatggtgcagaggccatacatttgcggaaattatgaaggacactgaactttttgagganagcatcatccgctgtatgcgtcgtctggacgaattgctccaagaaatgaataatgcggccaaatcgatgggcgataaagccatggagggaatgtttgagagggccagagtgatgctcaaaagggatattgttttttcggcctctctttatnnnnnn

SEQ ID NO: 594 - DNA, 1377 bp, Artificial Sequence
  Description of Artificial Sequence: Synthetic polynucleotide
  modified_base (1)..(315): a, c, t, g, unknown or other
  modified_base (420)..(420): a, c, t, g, unknown or other
  modified_base (876)..(876): a, c, t, g, unknown or other
  modified_base (1074)..(1074): a, c, t, g, unknown or other
  modified_base (1177)..(1377): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggcgataaaataccatttgtccaattggttggttcggaagttttttccagtgaagtgaaaaagaccgaagtgctaatggagaatttccgacgagcaataggnagtccgaataaaggagtaaaagaagtatttgaaggagaggtggttgatttaacacagatggaaacagcagaaactgatggatatggtggaaaaacaatttcgcatgttcttgcactaaaaacaacaaaaggatcaagagaacttcgattggatccaagtgtttacgattcattgattaaacaaaaagtcactgccggcgatattatttacattgaagcaggctcgggaaccgtcaaacgattgggtcgatcggacatttttgcaaatgaatttgatttggactccgacgaatttgtgccaatgccaaagggcgatgtgcacaaaagcaaagaattggtacaatacataagtttgcatgatttcgatacggccaattcacaaccacatggaaaggcaggcgatgtgatgtcaatgctctctcaaatattgaaaccgagaaagaccgaaatttcaagnaaactcagagcggaagtgaacaaggtggtcgatcaactcattgaggagggtcaagctgaattgctgcctggcgtactttttattgatgaggttcacatgcttgacatggaatgctttacatttctccatcgagcactcgaatccgaaatcagtccaattattgtattcgccacaaatcgtggacgaactaaaatcagnaattccgatgaagtcagcttttatggtattccggcggatttgattgatcgcctattgattgtgccaacaaaactttattctgttgaagaaatgtcaatggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 595 - DNA, 660 bp, Artificial Sequence
  Description of Artificial Sequence: Synthetic polynucleotide
  modified_base (1)..(21): a, c, t, g, unknown or other
  modified_base (82)..(84): a, c, t, g, unknown or other
  modified_base (181)..(246): a, c, t, g, unknown or other
  modified_base (391)..(393): a, c, t, g, unknown or other
  modified_base (447)..(447): a, c, t, g, unknown or other
  modified_base (604)..(660): a, c, t, g, unknown or other
nnnnnnnnnnnnnnnnnnnnnctctcttttgagatgttgtgttttcctccaaatggccaatataaactcccaacaatgccgnnngagccaatttatgatgtcaatttgggcgaagataaattcaaaacgaataagcggatgatcgatgcgaggggttatgaaccaatccatacagaagtannnnnnnnnnnnnnnnnnnnnnnnnnnnnnnnnnnnnnnnnnnnnnnnnnnnnnnnnnnnnnnnnnatttaggaaaatatcaattcaaaactcaaaagcaggcaatttgccatttggagagtggatccgccatggcttccacgcaccagaaaatcacctgggacgaagcatggtggcgggcgcggatccatccatcattatgaaacgccgnnntcggctggccggattattttggaagttggcggttatatcacggaagccgaggcncgctcatatttgatgtatttccatcagcgctttcctttccccgttgaattcaccagccaacaaattctcgataaaaaacgtgaaatggaagcaaaaatgatggaattgaaccgaaacaaatttgactgggacactgtgatcaaatataatatgcagnnnnnnnnnnnnnnnnnnnnnnnnnnnnnnnnnnnnnnnnnnnnnnnnnnnnnnnnn

SEQ ID NO: 596 - DNA, 510 bp, Artificial Sequence
  Description of Artificial Sequence: Synthetic polynucleotide
  modified_base (1)..(153): a, c, t, g, unknown or other
  modified_base (194)..(195): a, c, t, g, unknown or other
  modified_base (197)..(198): a, c, t, g, unknown or other
  modified_base (204)..(204): a, c, t, g, unknown or other
  modified_base (209)..(209): a, c, t, g, unknown or other
  modified_base (213)..(213): a, c, t, g, unknown or other
  modified_base (220)..(220): a, c, t, g, unknown or other
  modified_base (222)..(223): a, c, t, g, unknown or other
  modified_base (225)..(228): a, c, t, g, unknown or other
  modified_base (230)..(231): a, c, t, g, unknown or other
  modified_base (240)..(241): a, c, t, g, unknown or other
  modified_base (243)..(243): a, c, t, g, unknown or other
  modified_base (246)..(247): a, c, t, g, unknown or other
  modified_base (249)..(249): a, c, t, g, unknown or other
  modified_base (322)..(510): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcgtgtatgtccgttgccagacccgatttggtaatganngnnattatnccggnggtnatggccngnntnnnngnnatttatggnntngtnntngcagtcatcatttctggcaaagttggagttggcggcaaagattataaaatctatgagggatttgcccattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 597 - DNA, 11304 bp, Artificial Sequence
  Description of Artificial Sequence: Synthetic polynucleotide
  modified_base (1)..(1242): a, c, t, g, unknown or other
  modified_base (1274)..(1274): a, c, t, g, unknown or other
  modified_base (1276)..(1278): a, c, t, g, unknown or other
  modified_base (1287)..(1292): a, c, t, g, unknown or other
  modified_base (1294)..(1294): a, c, t, g, unknown or other
  modified_base (1296)..(1296): a, c, t, g, unknown or other
  modified_base (1299)..(1301): a, c, t, g, unknown or other
  modified_base (1307)..(1307): a, c, t, g, unknown or other
  modified_base (1311)..(1311): a, c, t, g, unknown or other
  modified_base (1313)..(1315): a, c, t, g, unknown or other
  modified_base (1317)..(1318): a, c, t, g, unknown or other
  modified_base (1320)..(1321): a, c, t, g, unknown or other
  modified_base (1323)..(1323): a, c, t, g, unknown or other
  modified_base (1327)..(1329): a, c, t, g, unknown or other
  modified_base (1333)..(1335): a, c, t, g, unknown or other
  modified_base (1338)..(1338): a, c, t, g, unknown or other
  modified_base (1341)..(1342): a, c, t, g, unknown or other
  modified_base (1345)..(1347): a, c, t, g, unknown or other
  modified_base (1349)..(1351): a, c, t, g, unknown or other
  modified_base (1353)..(1353): a, c, t, g, unknown or other
  modified_base (1356)..(1358): a, c, t, g, unknown or other
  modified_base (1362)..(1363): a, c, t, g, unknown or other
  modified_base (1365)..(1366): a, c, t, g, unknown or other
  modified_base (1368)..(1368): a, c, t, g, unknown or other
  modified_base (1372)..(1375): a, c, t, g, unknown or other
  modified_base (1377)..(1380): a, c, t, g, unknown or other
  modified_base (1383)..(1383): a, c, t, g, unknown or other
  modified_base (1386)..(1386): a, c, t, g, unknown or other
  modified_base (1389)..(1392): a, c, t, g, unknown or other
  modified_base (1395)..(1395): a, c, t, g, unknown or other
  modified_base (1430)..(1431): a, c, t, g, unknown or other
  modified_base (1440)..(1443): a, c, t, g, unknown or other
  modified_base (1445)..(1445): a, c, t, g, unknown or other
  modified_base (1448)..(1448): a, c, t, g, unknown or other
  modified_base (1453)..(1455): a, c, t, g, unknown or other
  modified_base (1459)..(1459): a, c, t, g, unknown or other
  modified_base (1461)..(1461): a, c, t, g, unknown or other
  modified_base (1465)..(1467): a, c, t, g, unknown or other
  modified_base (1470)..(1473): a, c, t, g, unknown or other
  modified_base (1476)..(1476): a, c, t, g, unknown or other
  modified_base (1478)..(1478): a, c, t, g, unknown or other
  modified_base (1481)..(1482): a, c, t, g, unknown or other
  modified_base (1485)..(1488): a, c, t, g, unknown or other
  modified_base (1491)..(1500): a, c, t, g, unknown or other
  modified_base (1502)..(1503): a, c, t, g, unknown or other
  modified_base (1506)..(1506): a, c, t, g, unknown or other
  modified_base (1509)..(1511): a, c, t, g, unknown or other
  modified_base (1513)..(1524): a, c, t, g, unknown or other
  modified_base (1526)..(1528): a, c, t, g, unknown or other
  modified_base (1530)..(1531): a, c, t, g, unknown or other
  modified_base (1534)..(1536): a, c, t, g, unknown or other
  modified_base (1538)..(1541): a, c, t, g, unknown or other
  modified_base (1543)..(1550): a, c, t, g, unknown or other
  modified_base (1552)..(1558): a, c, t, g, unknown or other
  modified_base (1561)..(1561): a, c, t, g, unknown or other
  modified_base (1563)..(1563): a, c, t, g, unknown or other
  modified_base (1569)..(1570): a, c, t, g, unknown or other
  modified_base (1572)..(1575): a, c, t, g, unknown or other
  modified_base (1577)..(1580): a, c, t, g, unknown or other
  modified_base (1582)..(1583): a, c, t, g, unknown or other
  modified_base (1585)..(1585): a, c, t, g, unknown or other
  modified_base (1587)..(1587): a, c, t, g, unknown or other
  modified_base (1591)..(1595): a, c, t, g, unknown or other
  modified_base (1597)..(1599): a, c, t, g, unknown or other
  modified_base (1603)..(1604): a, c, t, g, unknown or other
  modified_base (1609)..(1609): a, c, t, g, unknown or other
  modified_base (1611)..(1612): a, c, t, g, unknown or other
  modified_base (1614)..(1616): a, c, t, g, unknown or other
  modified_base (1717)..(1842): a, c, t, g, unknown or other
  modified_base (1866)..(1866): a, c, t, g, unknown or other
  modified_base (1878)..(1878): a, c, t, g, unknown or other
  modified_base (1885)..(1885): a, c, t, g, unknown or other
  modified_base (1887)..(1887): a, c, t, g, unknown or other
  modified_base (1891)..(1893): a, c, t, g, unknown or other
  modified_base (1896)..(1896): a, c, t, g, unknown or other
  modified_base (1901)..(1902): a, c, t, g, unknown or other
  modified_base (1905)..(1907): a, c, t, g, unknown or other
  modified_base (1913)..(1917): a, c, t, g, unknown or other
  modified_base (1919)..(1923): a, c, t, g, unknown or other
  modified_base (1926)..(1926): a, c, t, g, unknown or other
  modified_base (1928)..(1929): a, c, t, g, unknown or other
  modified_base (1932)..(1932): a, c, t, g, unknown or other
  modified_base (1935)..(1936): a, c, t, g, unknown or other
  modified_base (1938)..(1941): a, c, t, g, unknown or other
  modified_base (1943)..(1944): a, c, t, g, unknown or other
  modified_base (1946)..(1947): a, c, t, g, unknown or other
  modified_base (1950)..(1955): a, c, t, g, unknown or other
  modified_base (1962)..(1966): a, c, t, g, unknown or other
  modified_base (1969)..(1969): a, c, t, g, unknown or other
  modified_base (1987)..(1988): a, c, t, g, unknown or other
  modified_base (1990)..(1991): a, c, t, g, unknown or other
  modified_base (1993)..(1996): a, c, t, g, unknown or other
  modified_base (2016)..(2018): a, c, t, g, unknown or other
  modified_base (2022)..(2022): a, c, t, g, unknown or other
  modified_base (2036)..(2036): a, c, t, g, unknown or other
  modified_base (2040)..(2040): a, c, t, g, unknown or other
  modified_base (2042)..(2042): a, c, t, g, unknown or other
  modified_base (2049)..(2049): a, c, t, g, unknown or other
  modified_base (2053)..(2055): a, c, t, g, unknown or other
  modified_base (2060)..(2060): a, c, t, g, unknown or other
  modified_base (2069)..(2070): a, c, t, g, unknown or other
  modified_base (2082)..(2082): a, c, t, g, unknown or other
  modified_base (2085)..(2085): a, c, t, g, unknown or other
  modified_base (2098)..(2098): a, c, t, g, unknown or other
  modified_base (2103)..(2103): a, c, t, g, unknown or other
  modified_base (2112)..(2112): a, c, t, g, unknown or other
  modified_base (2114)..(2115): a, c, t, g, unknown or other
  modified_base (2118)..(2121): a, c, t, g, unknown or other
  modified_base (2131)..(2131): a, c, t, g, unknown or other
  modified_base (2143)..(2166): a, c, t, g, unknown or other
  modified_base (2259)..(2259): a, c, t, g, unknown or other
  modified_base (2307)..(2307): a, c, t, g, unknown or other
  modified_base (2316)..(2316): a, c, t, g, unknown or other
  modified_base (2349)..(2349): a, c, t, g, unknown or other
  modified_base (2352)..(2352): a, c, t, g, unknown or other
  modified_base (2355)..(2355): a, c, t, g, unknown or other
  modified_base (2389)..(2442): a, c, t, g, unknown or other
  modified_base (2574)..(2576): a, c, t, g, unknown or other
  modified_base (2581)..(2581): a, c, t, g, unknown or other
  modified_base (2598)..(2598): a, c, t, g, unknown or other
  modified_base (2604)..(2605): a, c, t, g, unknown or other
  modified_base (2619)..(2619): a, c, t, g, unknown or other
  modified_base (2621)..(2621): a, c, t, g, unknown or other
  modified_base (2623)..(2623): a, c, t, g, unknown or other
  modified_base (2644)..(2644): a, c, t, g, unknown or other
  modified_base (2685)..(2685): a, c, t, g, unknown or other
  modified_base (2690)..(2692): a, c, t, g, unknown or other
  modified_base (2697)..(2697): a, c, t, g, unknown or other
  modified_base (2727)..(2727): a, c, t, g, unknown or other
  modified_base (2730)..(2730): a, c, t, g, unknown or other
  modified_base (2745)..(2745): a, c, t, g, unknown or other
  modified_base (2750)..(2750): a, c, t, g, unknown or other
  modified_base (2754)..(2754): a, c, t, g, unknown or other
  modified_base (2759)..(2759): a, c, t, g, unknown or other
  modified_base (2763)..(2764): a, c, t, g, unknown or other
  modified_base (2766)..(2766): a, c, t, g, unknown or other
  modified_base (2784)..(2785): a, c, t, g, unknown or other
  modified_base (2787)..(2787): a, c, t, g, unknown or other
  modified_base (2805)..(2805): a, c, t, g, unknown or other
  modified_base (2819)..(2819): a, c, t, g, unknown or other
  modified_base (2838)..(2838): a, c, t, g, unknown or other
  modified_base (2841)..(2842): a, c, t, g, unknown or other
  modified_base (2848)..(2848): a, c, t, g, unknown or other
  modified_base (2850)..(2850): a, c, t, g, unknown or other
  modified_base (2853)..(2853): a, c, t, g, unknown or other
  modified_base (2868)..(2868): a, c, t, g, unknown or other
  modified_base (2877)..(2877): a, c, t, g, unknown or other
  modified_base (2880)..(2880): a, c, t, g, unknown or other
  modified_base (2885)..(2885): a, c, t, g, unknown or other
  modified_base (2904)..(2904): a, c, t, g, unknown or other
  modified_base (2911)..(2911): a, c, t, g, unknown or other
  modified_base (2916)..(2916): a, c, t, g, unknown or other
  modified_base (2928)..(2928): a, c, t, g, unknown or other
  modified_base (2930)..(2930): a, c, t, g, unknown or other
  modified_base (2938)..(2939): a, c, t, g, unknown or other
  modified_base (2949)..(2950): a, c, t, g, unknown or other
  modified_base (2954)..(2954): a, c, t, g, unknown or other
  modified_base (2964)..(2964): a, c, t, g, unknown or other
  modified_base (2977)..(2978): a, c, t, g, unknown or other
  modified_base (2980)..(2980): a, c, t, g, unknown or other
  modified_base (2991)..(2991): a, c, t, g, unknown or other
  modified_base (2997)..(2997): a, c, t, g, unknown or other
  modified_base (2999)..(3000): a, c, t, g, unknown or other
  modified_base (3004)..(3004): a, c, t, g, unknown or other
  modified_base (3012)..(3012): a, c, t, g, unknown or other
  modified_base (3014)..(3015): a, c, t, g, unknown or other
  modified_base (3052)..(3231): a, c, t, g, unknown or other
  modified_base (3283)..(3283): a, c, t, g, unknown or other
  modified_base (3309)..(3309): a, c, t, g, unknown or other
  modified_base (3316)..(3316): a, c, t, g, unknown or other
  modified_base (3324)..(3327): a, c, t, g, unknown or other
  modified_base (3329)..(3329): a, c, t, g, unknown or other
  modified_base (3331)..(3331): a, c, t, g, unknown or other
  modified_base (3336)..(3336): a, c, t, g, unknown or other
  modified_base (3346)..(3346): a, c, t, g, unknown or other
  modified_base (3354)..(3354): a, c, t, g, unknown or other
  modified_base (3358)..(3358): a, c, t, g, unknown or other
  modified_base (3376)..(3376): a, c, t, g, unknown or other
  modified_base (3379)..(3380): a, c, t, g, unknown or other
  modified_base (3387)..(3389): a, c, t, g, unknown or other
  modified_base (3394)..(3394): a, c, t, g, unknown or other
  modified_base (3397)..(3397): a, c, t, g, unknown or other
  modified_base (3408)..(3408): a, c, t, g, unknown or other
  modified_base (3414)..(3414): a, c, t, g, unknown or other
  modified_base (3417)..(3417): a, c, t, g, unknown or other
  modified_base (3419)..(3419): a, c, t, g, unknown or other
  modified_base (3431)..(3431): a, c, t, g, unknown or other
  modified_base (3445)..(3445): a, c, t, g, unknown or other
  modified_base (3469)..(3471): a, c, t, g, unknown or other
  modified_base (3475)..(3475): a, c, t, g, unknown or other
  modified_base (3478)..(3480): a, c, t, g, unknown or other
  modified_base (3492)..(3492): a, c, t, g, unknown or other
  modified_base (3495)..(3496): a, c, t, g, unknown or other
  modified_base (3502)..(3503): a, c, t, g, unknown or other
  modified_base (3505)..(3505): a, c, t, g, unknown or other
  modified_base (3510)..(3511): a, c, t, g, unknown or other
  modified_base (3513)..(3513): a, c, t, g, unknown or other
  modified_base (3522)..(3522): a, c, t, g, unknown or other
  modified_base (3525)..(3526): a, c, t, g, unknown or other
  modified_base (3528)..(3528): a, c, t, g, unknown or other
  modified_base (3536)..(3536): a, c, t, g, unknown or other
  modified_base (3548)..(3548): a, c, t, g, unknown or other
  modified_base (3551)..(3552): a, c, t, g, unknown or other
  modified_base (3561)..(3561): a, c, t, g, unknown or other
  modified_base (3572)..(3572): a, c, t, g, unknown or other
  modified_base (3582)..(3582): a, c, t, g, unknown or other
  modified_base (3586)..(3586): a, c, t, g, unknown or other
  modified_base (3591)..(3591): a, c, t, g, unknown or other
  modified_base (3600)..(3600): a, c, t, g, unknown or other
  modified_base (3602)..(3602): a, c, t, g, unknown or other
  modified_base (3609)..(3609): a, c, t, g, unknown or other
  modified_base (3612)..(3612): a, c, t, g, unknown or other
  modified_base (3616)..(3616): a, c, t, g, unknown or other
  modified_base (3622)..(3625): a, c, t, g, unknown or other
  modified_base (3627)..(3628): a, c, t, g, unknown or other
  modified_base (3630)..(3630): a, c, t, g, unknown or other
  modified_base (3632)..(3639): a, c, t, g, unknown or other
  modified_base (3642)..(3642): a, c, t, g, unknown or other
  modified_base (3646)..(3646): a, c, t, g, unknown or other
  modified_base (3650)..(3650): a, c, t, g, unknown or other
  modified_base (3654)..(3654): a, c, t, g, unknown or other
  modified_base (3658)..(3750): a, c, t, g, unknown or other
  modified_base (3783)..(3786): a, c, t, g, unknown or other
  modified_base (3790)..(3791): a, c, t, g, unknown or other
  modified_base (3793)..(3798): a, c, t, g, unknown or other
  modified_base (3801)..(3801): a, c, t, g, unknown or other
  modified_base (3803)..(3804): a, c, t, g, unknown or other
  modified_base (3806)..(3807): a, c, t, g, unknown or other
  modified_base (3816)..(3816): a, c, t, g, unknown or other
  modified_base (3828)..(3828): a, c, t, g, unknown or other
  modified_base (3850)..(3850): a, c, t, g, unknown or other
  modified_base (3855)..(3855): a, c, t, g, unknown or other
  modified_base (3861)..(3861): a, c, t, g, unknown or other
  modified_base (3863)..(3863): a, c, t, g, unknown or other
  modified_base (3865)..(3865): a, c, t, g, unknown or other
  modified_base (3875)..(3876): a, c, t, g, unknown or other
  modified_base (3879)..(3879): a, c, t, g, unknown or other
  modified_base (3885)..(3888): a, c, t, g, unknown or other
  modified_base (3892)..(3892): a, c, t, g, unknown or other
  modified_base (3894)..(3896): a, c, t, g, unknown or other
  modified_base (3900)..(3900): a, c, t, g, unknown or other
  modified_base (3903)..(3903): a, c, t, g, unknown or other
  modified_base (3912)..(3912): a, c, t, g, unknown or other
  modified_base (3918)..(3918): a, c, t, g, unknown or other
  modified_base (3933)..(3933): a, c, t, g, unknown or other
  modified_base (3936)..(3936): a, c, t, g, unknown or other
  modified_base (3954)..(3957): a, c, t, g, unknown or other
  modified_base (3966)..(3967): a, c, t, g, unknown or other
  modified_base (3969)..(3969): a, c, t, g, unknown or other
  modified_base (3972)..(3973): a, c, t, g, unknown or other
  modified_base (3975)..(3975): a, c, t, g, unknown or other
  modified_base (3981)..(3981): a, c, t, g, unknown or other
  modified_base (3983)..(3985): a, c, t, g, unknown or other
  modified_base (3990)..(3992): a, c, t, g, unknown or other
  modified_base (3997)..(3999): a, c, t, g, unknown or other
  modified_base (4001)..(4002): a, c, t, g, unknown or other
  modified_base (4005)..(4008): a, c, t, g, unknown or other
  modified_base (4017)..(4018): a, c, t, g, unknown or other
  modified_base (4020)..(4020): a, c, t, g, unknown or other
  modified_base (4026)..(4026): a, c, t, g, unknown or other
  modified_base (4036)..(4036): a, c, t, g, unknown or other
  modified_base (4038)..(4038): a, c, t, g, unknown or other
  modified_base (4044)..(4044): a, c, t, g, unknown or other
  modified_base (4152)..(4152): a, c, t, g, unknown or other
  modified_base (4180)..(4209): a, c, t, g, unknown or other
  modified_base (4249)..(4251): a, c, t, g, unknown or other
  modified_base (4414)..(4668): a, c, t, g, unknown or other
  modified_base (4824)..(4824): a, c, t, g, unknown or other
  modified_base (4844)..(4844): a, c, t, g, unknown or other
  modified_base (4857)..(4859): a, c, t, g, unknown or other
  modified_base (4863)..(4863): a, c, t, g, unknown or other
  modified_base (4876)..(4878): a, c, t, g, unknown or other
  modified_base (4881)..(4881): a, c, t, g, unknown or other
  modified_base (4923)..(4923): a, c, t, g, unknown or other
  modified_base (4930)..(4930): a, c, t, g, unknown or other
  modified_base (4932)..(4932): a, c, t, g, unknown or other
  modified_base (4956)..(4956): a, c, t, g, unknown or other
  modified_base (4960)..(4960): a, c, t, g, unknown or other
  modified_base (4967)..(4969): a, c, t, g, unknown or other
  modified_base (4999)..(4999): a, c, t, g, unknown or other
  modified_base (5007)..(5007): a, c, t, g, unknown or other
  modified_base (5037)..(5037): a, c, t, g, unknown or other
  modified_base (5073)..(5073): a, c, t, g, unknown or other
  modified_base (5079)..(5079): a, c, t, g, unknown or other
  modified_base (5082)..(5082): a, c, t, g, unknown or other
  modified_base (5089)..(5089): a, c, t, g, unknown or other
  modified_base (5091)..(5091): a, c, t, g, unknown or other
  modified_base (5093)..(5093): a, c, t, g, unknown or other
  modified_base (5096)..(5099): a, c, t, g, unknown or other
  modified_base (5106)..(5106): a, c, t, g, unknown or other
  modified_base (5124)..(5124): a, c, t, g, unknown or other
  modified_base (5137)..(5137): a, c, t, g, unknown or other
  modified_base (5139)..(5139): a, c, t, g, unknown or other
  modified_base (5141)..(5141): a, c, t, g, unknown or other
  modified_base (5145)..(5146): a, c, t, g, unknown or other
  modified_base (5150)..(5151): a, c, t, g, unknown or other
  modified_base (5161)..(5161): a, c, t, g, unknown or other
  modified_base (5164)..(5164): a, c, t, g, unknown or other
  modified_base (5167)..(5167): a, c, t, g, unknown or other
  modified_base (5174)..(5175): a, c, t, g, unknown or other
  modified_base (5181)..(5181): a, c, t, g, unknown or other
  modified_base (5199)..(5199): a, c, t, g, unknown or other
  modified_base (5202)..(5202): a, c, t, g, unknown or other
  modified_base (5212)..(5216): a, c, t, g, unknown or other
  modified_base (5218)..(5220): a, c, t, g, unknown or other
  modified_base (5222)..(5226): a, c, t, g, unknown or other
  modified_base (5229)..(5232): a, c, t, g, unknown or other
  modified_base (5235)..(5236): a, c, t, g, unknown or other
  modified_base (5239)..(5239): a, c, t, g, unknown or other
  modified_base (5241)..(5245): a, c, t, g, unknown or other
  modified_base (5250)..(5250): a, c, t, g, unknown or other
  modified_base (5257)..(5257): a, c, t, g, unknown or other
  modified_base (5266)..(5266): a, c, t, g, unknown or other
  modified_base (5268)..(5269): a, c, t, g, unknown or other
  modified_base (5271)..(5271): a, c, t, g, unknown or other
  modified_base (5273)..(5277): a, c, t, g, unknown or other
  modified_base (5279)..(5279): a, c, t, g, unknown or other
  modified_base (5283)..(5283): a, c, t, g, unknown or other
  modified_base (5297)..(5297): a, c, t, g, unknown or other
  modified_base (5311)..(5314): a, c, t, g, unknown or other
  modified_base (5322)..(5322): a, c, t, g, unknown or other
  modified_base (5329)..(5331): a, c, t, g, unknown or other
  modified_base (5343)..(5343): a, c, t, g, unknown or other
  modified_base (5352)..(5352): a, c, t, g, unknown or other
  modified_base (5358)..(5358): a, c, t, g, unknown or other
  modified_base (5361)..(5361): a, c, t, g, unknown or other
  modified_base (5364)..(5365): a, c, t, g, unknown or other
  modified_base (5372)..(5373): a, c, t, g, unknown or other
  modified_base (5383)..(5383): a, c, t, g, unknown or other
  modified_base (5388)..(5388): a, c, t, g, unknown or other
  modified_base (5409)..(5409): a, c, t, g, unknown or other
  modified_base (5412)..(5412): a, c, t, g, unknown or other
  modified_base (5420)..(5420): a, c, t, g, unknown or other
  modified_base (5425)..(5426): a, c, t, g, unknown or other
  modified_base (5431)..(5431): a, c, t, g, unknown or other
  modified_base (5437)..(5439): a, c, t, g, unknown or other
  modified_base (5444)..(5444): a, c, t, g, unknown or other
  modified_base (5452)..(5452): a, c, t, g, unknown or other
  modified_base (5466)..(5466): a, c, t, g, unknown or other
  modified_base (5469)..(5469): a, c, t, g, unknown or other
  modified_base (5475)..(5475): a, c, t, g, unknown or other
  modified_base (5483)..(5483): a, c, t, g, unknown or other
  modified_base (5489)..(5489): a, c, t, g, unknown or other
  modified_base (5493)..(5493): a, c, t, g, unknown or other
  modified_base (5502)..(5502): a, c, t, g, unknown or other
  modified_base (5509)..(5509): a, c, t, g, unknown or other
  modified_base (5514)..(5515): a, c, t, g, unknown or other
  modified_base (5521)..(5521): a, c, t, g, unknown or other
  modified_base (5523)..(5523): a, c, t, g, unknown or other
  modified_base (5527)..(5527): a, c, t, g, unknown or other
  modified_base (5543)..(5543): a, c, t, g, unknown or other
  modified_base (5560)..(5560): a, c, t, g, unknown or other
  modified_base (5562)..(5562): a, c, t, g, unknown or other
  modified_base (5568)..(5568): a, c, t, g, unknown or other
  modified_base (5580)..(5580): a, c, t, g, unknown or other
  modified_base (5584)..(5584): a, c, t, g, unknown or other
  modified_base (5604)..(5604): a, c, t, g, unknown or other
  modified_base (5610)..(5613): a, c, t, g, unknown or other
  modified_base (5618)..(5618): a, c, t, g, unknown or other
  modified_base (5623)..(5623): a, c, t, g, unknown or other
  modified_base (5636)..(5636): a, c, t, g, unknown or other
  modified_base (5646)..(5646): a, c, t, g, unknown or other
  modified_base (5649)..(5649): a, c, t, g, unknown or other
  modified_base (5658)..(5658): a, c, t, g, unknown or other
  modified_base (5662)..(5662): a, c, t, g, unknown or other
  modified_base (5668)..(5669): a, c, t, g, unknown or other
  modified_base (5674)..(5674): a, c, t, g, unknown or other
  modified_base (5688)..(5688): a, c, t, g, unknown or other
  modified_base (5691)..(5691): a, c, t, g, unknown or other
  modified_base (5697)..(5697): a, c, t, g, unknown or other
  modified_base (5737)..(5737): a, c, t, g, unknown or other
  modified_base (5753)..(5753): a, c, t, g, unknown or other
  modified_base (5761)..(5762): a, c, t, g, unknown or other
  modified_base (5766)..(5766): a, c, t, g, unknown or other
  modified_base (5792)..(5792): a, c, t, g, unknown or other
  modified_base (5799)..(5799): a, c, t, g, unknown or other
  modified_base (5811)..(5811): a, c, t, g, unknown or other
  modified_base (5817)..(5817): a, c, t, g, unknown or other
  modified_base (5819)..(5819): a, c, t, g, unknown or other
  modified_base (5823)..(5823): a, c, t, g, unknown or other
  modified_base (5827)..(5827): a, c, t, g, unknown or other
  modified_base (5830)..(5830): a, c, t, g, unknown or other
  modified_base (5834)..(5834): a, c, t, g, unknown or other
  modified_base (5836)..(5836): a, c, t, g, unknown or other
  modified_base (5846)..(5847): a, c, t, g, unknown or other
  modified_base (5862)..(5863): a, c, t, g, unknown or other
  modified_base (5877)..(5877): a, c, t, g, unknown or other
  modified_base (5883)..(5883): a, c, t, g, unknown or other
  modified_base (5887)..(5887): a, c, t, g, unknown or other
  modified_base (5893)..(5893): a, c, t, g, unknown or other
  modified_base (5906)..(5906): a, c, t, g, unknown or other
  modified_base (5910)..(5911): a, c, t, g, unknown or other
  modified_base (5934)..(5934): a, c, t, g, unknown or other
  modified_base (5943)..(5943): a, c, t, g, unknown or other
  modified_base (5947)..(5948): a, c, t, g, unknown or other
  modified_base (5950)..(5950): a, c, t, g, unknown or other
  modified_base (5961)..(5961): a, c, t, g, unknown or other
  modified_base (5974)..(5974): a, c, t, g, unknown or other
  modified_base (5988)..(5988): a, c, t, g, unknown or other
  modified_base (5991)..(5991): a, c, t, g, unknown or other
  modified_base (5994)..(5995): a, c, t, g, unknown or other
  modified_base (6000)..(6000): a, c, t, g, unknown or other
  modified_base (6003)..(6003): a, c, t, g, unknown or other
  modified_base (6005)..(6005): a, c, t, g, unknown or other
  modified_base (6022)..(6022): a, c, t, g, unknown or other
  modified_base (6024)..(6024): a, c, t, g, unknown or other
  modified_base (6031)..(6033): a, c, t, g, unknown or other
  modified_base (6037)..(6038): a, c, t, g, unknown or other
  modified_base (6049)..(6053): a, c, t, g, unknown or other
  modified_base (6058)..(6058): a, c, t, g, unknown or other
  modified_base (6065)..(6065): a, c, t, g, unknown or other
  modified_base (6070)..(6070): a, c, t, g, unknown or other
  modified_base (6072)..(6072): a, c, t, g, unknown or other
  modified_base (6094)..(6095): a, c, t, g, unknown or other
  modified_base (6100)..(6101): a, c, t, g, unknown or other
  modified_base (6105)..(6105): a, c, t, g, unknown or other
  modified_base (6108)..(6108): a, c, t, g, unknown or other
  modified_base (6117)..(6117): a, c, t, g, unknown or other
  modified_base (6121)..(6121): a, c, t, g, unknown or other
  modified_base (6127)..(6127): a, c, t, g, unknown or other
  modified_base (6137)..(6138): a, c, t, g, unknown or other
  modified_base (6140)..(6140): a, c, t, g, unknown or other
  modified_base (6150)..(6150): a, c, t, g, unknown or other
  modified_base (6154)..(6154): a, c, t, g, unknown or other
  modified_base (6157)..(6162): a, c, t, g, unknown or other
  modified_base (6164)..(6165): a, c, t, g, unknown or other
  modified_base (6167)..(6167): a, c, t, g, unknown or other
  modified_base (6171)..(6171): a, c, t, g, unknown or other
  modified_base (6174)..(6175): a, c, t, g, unknown or other
  modified_base (6180)..(6180): a, c, t, g, unknown or other
  modified_base (6184)..(6184): a, c, t, g, unknown or other
  modified_base (6186)..(6186): a, c, t, g, unknown or other
  modified_base (6189)..(6189): a, c, t, g, unknown or other
  modified_base (6226)..(6228): a, c, t, g, unknown or other
  modified_base (6261)..(6261): a, c, t, g, unknown or other
  modified_base (6266)..(6266): a, c, t, g, unknown or other
  modified_base (6268)..(6268): a, c, t, g, unknown or other
  modified_base (6338)..(6339): a, c, t, g, unknown or other
  modified_base (6352)..(6352): a, c, t, g, unknown or other
  modified_base (6355)..(6355): a, c, t, g, unknown or other
  modified_base (6360)..(6361): a, c, t, g, unknown or other
  modified_base (6367)..(6367): a, c, t, g, unknown or other
  modified_base (6369)..(6369): a, c, t, g, unknown or other
  modified_base (6375)..(6375): a, c, t, g, unknown or other
  modified_base (6378)..(6378): a, c, t, g, unknown or other
  modified_base (6380)..(6380): a, c, t, g, unknown or other
  modified_base (6387)..(6387): a, c, t, g, unknown or other
  modified_base (6394)..(6394): a, c, t, g, unknown or other
  modified_base (6396)..(6396): a, c, t, g, unknown or other
  modified_base (6400)..(6400): a, c, t, g, unknown or other
  modified_base (6405)..(6405): a, c, t, g, unknown or other
  modified_base (6430)..(6430): a, c, t, g, unknown or other
  modified_base (6447)..(6448): a, c, t, g, unknown or other
  modified_base (6454)..(6455): a, c, t, g, unknown or other
  modified_base (6482)..(6483): a, c, t, g, unknown or other
  modified_base (6507)..(6507): a, c, t, g, unknown or other
  modified_base (6514)..(6514): a, c, t, g, unknown or other
  modified_base (6523)..(6523): a, c, t, g, unknown or other
  modified_base (6526)..(6528): a, c, t, g, unknown or other
  modified_base (6541)..(6541): a, c, t, g, unknown or other
  modified_base (6543)..(6543): a, c, t, g, unknown or other
  modified_base (6547)..(6548): a, c, t, g, unknown or other
  modified_base (6576)..(6576): a, c, t, g, unknown or other
  modified_base (6587)..(6588): a, c, t, g, unknown or other
  modified_base (6595)..(6595): a, c, t, g, unknown or other
  modified_base (6615)..(6616): a, c, t, g, unknown or other
  modified_base (6622)..(6624): a, c, t, g, unknown or other
  modified_base (6631)..(6631): a, c, t, g, unknown or other
  modified_base (6651)..(6652): a, c, t, g, unknown or other
  modified_base (6654)..(6655): a, c, t, g, unknown or other
  modified_base (6661)..(6661): a, c, t, g, unknown or other
  modified_base (6663)..(6663): a, c, t, g, unknown or other
  modified_base (6686)..(6687): a, c, t, g, unknown or other
  modified_base (6691)..(6691): a, c, t, g, unknown or other
  modified_base (6694)..(6694): a, c, t, g, unknown or other
  modified_base (6713)..(6713): a, c, t, g, unknown or other
  modified_base (6741)..(6741): a, c, t, g, unknown or other
  modified_base (6747)..(6748): a, c, t, g, unknown or other
  modified_base (6755)..(6755): a, c, t, g, unknown or other
  modified_base (6759)..(6759): a, c, t, g, unknown or other
  modified_base (6778)..(6778): a, c, t, g, unknown or other
  modified_base (6780)..(6780): a, c, t, g, unknown or other
  modified_base (6797)..(6797): a, c, t, g, unknown or other
  modified_base (6811)..(6811): a, c, t, g, unknown or other
  modified_base (6831)..(6831): a, c, t, g, unknown or other
  modified_base (6849)..(6849): a, c, t, g, unknown or other
  modified_base (6852)..(6852): a, c, t, g, unknown or other
  modified_base (6889)..(6915): a, c, t, g, unknown or other
  modified_base (6945)..(6945): a, c, t, g, unknown or other
  modified_base (6947)..(6947): a, c, t, g, unknown or other
  modified_base (6949)..(6950): a, c, t, g, unknown or other
  modified_base (6963)..(6963): a, c, t, g, unknown or other
  modified_base (6977)..(6977): a, c, t, g, unknown or other
  modified_base (6984)..(6984): a, c, t, g, unknown or other
  modified_base (6993)..(6993): a, c, t, g, unknown or other
  modified_base (7002)..(7002): a, c, t, g, unknown or other
  modified_base (7016)..(7016): a, c, t, g, unknown or other
  modified_base (7027)..(7027): a, c, t, g, unknown or other
  modified_base (7029)..(7029): a, c, t, g, unknown or other
  modified_base (7032)..(7034): a, c, t, g, unknown or other
  modified_base (7036)..(7036): a, c, t, g, unknown or other
  modified_base (7038)..(7038): a, c, t, g, unknown or other
  modified_base (7044)..(7044): a, c, t, g, unknown or other
  modified_base (7049)..(7050): a, c, t, g, unknown or other
  modified_base (7066)..(7066): a, c, t, g, unknown or other
  modified_base (7074)..(7074): a, c, t, g, unknown or other
  modified_base (7097)..(7097): a, c, t, g, unknown or other
  modified_base (7105)..(7105): a, c, t, g, unknown or other
  modified_base (7107)..(7107): a, c, t, g, unknown or other
  modified_base (7109)..(7109): a, c, t, g, unknown or other
  modified_base (7114)..(7114): a, c, t, g, unknown or other
  modified_base (7116)..(7116): a, c, t, g, unknown or other
  modified_base (7133)..(7133): a, c, t, g, unknown or other
  modified_base (7137)..(7139): a, c, t, g, unknown or other
  modified_base (7154)..(7154): a, c, t, g, unknown or other
  modified_base (7159)..(7159): a, c, t, g, unknown or other
  modified_base (7165)..(7167): a, c, t, g, unknown or other
  modified_base (7198)..(7198): a, c, t, g, unknown or other
  modified_base (7209)..(7209): a, c, t, g, unknown or other
  modified_base (7218)..(7218): a, c, t, g, unknown or other
  modified_base (7225)..(7225): a, c, t, g, unknown or other
  modified_base (7227)..(7227): a, c, t, g, unknown or other
  modified_base (7230)..(7234): a, c, t, g, unknown or other
  modified_base (7236)..(7238): a, c, t, g, unknown or other
  modified_base (7243)..(7243): a, c, t, g, unknown or other
  modified_base (7245)..(7249): a, c, t, g, unknown or other
  modified_base (7251)..(7251): a, c, t, g, unknown or other
  modified_base (7254)..(7254): a, c, t, g, unknown or other
  modified_base (7401)..(7401): a, c, t, g, unknown or other
  modified_base (7434)..(7434): a, c, t, g, unknown or other
  modified_base (7437)..(7437): a, c, t, g, unknown or other
  modified_base (7477)..(7557): a, c, t, g, unknown or other
  modified_base (7603)..(7605): a, c, t, g, unknown or other
  modified_base (7631)..(7631): a, c, t, g, unknown or other
  modified_base (7635)..(7638): a, c, t, g, unknown or other
  modified_base (7640)..(7641): a, c, t, g, unknown or other
  modified_base (7643)..(7644): a, c, t, g, unknown or other
  modified_base (7647)..(7647): a, c, t, g, unknown or other
  modified_base (7650)..(7650): a, c, t, g, unknown or other
  modified_base (7653)..(7655): a, c, t, g, unknown or other
  modified_base (7659)..(7661): a, c, t, g, unknown or other
  modified_base (7663)..(7667): a, c, t, g, unknown or other
  modified_base (7669)..(7671): a, c, t, g, unknown or other
  modified_base (7674)..(7674): a, c, t, g, unknown or other
  modified_base (7678)..(7678): a, c, t, g, unknown or other
  modified_base (7682)..(7683): a, c, t, g, unknown or other
  modified_base (7686)..(7689): a, c, t, g, unknown or other
  modified_base (7692)..(7695): a, c, t, g, unknown or other
  modified_base (7697)..(7704): a, c, t, g, unknown or other
  modified_base (7707)..(7711): a, c, t, g, unknown or other
  modified_base (7714)..(7722): a, c, t, g, unknown or other
  modified_base (7725)..(7726): a, c, t, g, unknown or other
  modified_base (7750)..(7755): a, c, t, g, unknown or other
  modified_base (7773)..(7773): a, c, t, g, unknown or other
  modified_base (7783)..(7783): a, c, t, g, unknown or other
  modified_base (7785)..(7785): a, c, t, g, unknown or other
  modified_base (7806)..(7806): a, c, t, g, unknown or other
  modified_base (7808)..(7809): a, c, t, g, unknown or other
  modified_base (7818)..(7819): a, c, t, g, unknown or other
  modified_base (7871)..(7871): a, c, t, g, unknown or other
  modified_base (7874)..(7874): a, c, t, g, unknown or other
  modified_base (7878)..(7878): a, c, t, g, unknown or other
  modified_base (7909)..(7909): a, c, t, g, unknown or other
  modified_base (7915)..(7916): a, c, t, g, unknown or other
  modified_base (7920)..(7920): a, c, t, g, unknown or other
  modified_base (7942)..(7942): a, c, t, g, unknown or other
  modified_base (7944)..(7944): a, c, t, g, unknown or other
  modified_base (7963)..(7963): a, c, t, g, unknown or other
  modified_base (7975)..(7975): a, c, t, g, unknown or other
  modified_base (7977)..(7978): a, c, t, g, unknown or other
  modified_base (7986)..(7987): a, c, t, g, unknown or other
  modified_base (7989)..(7989): a, c, t, g, unknown or other
  modified_base (7992)..(7992): a, c, t, g, unknown or other
  modified_base (7997)..(7998): a, c, t, g, unknown or other
  modified_base (8000)..(8000): a, c, t, g, unknown or other
  modified_base (8008)..(8008): a, c, t, g, unknown or other
  modified_base (8020)..(8020): a, c, t, g, unknown or other
  modified_base (8026)..(8026): a, c, t, g, unknown or other
  modified_base (8035)..(8035): a, c, t, g, unknown or other
  modified_base (8041)..(8041): a, c, t, g, unknown or other
  modified_base (8044)..(8044): a, c, t, g, unknown or other
  modified_base (8053)..(8053): a, c, t, g, unknown or other
  modified_base (8055)..(8055): a, c, t, g, unknown or other
  modified_base (8061)..(8061): a, c, t, g, unknown or other
  modified_base (8069)..(8069): a, c, t, g, unknown or other
  modified_base (8076)..(8076): a, c, t, g, unknown or other
  modified_base (8078)..(8078): a, c, t, g, unknown or other
  modified_base (8081)..(8082): a, c, t, g, unknown or other
  modified_base (8085)..(8086): a, c, t, g, unknown or other
  modified_base (8092)..(8093): a, c, t, g, unknown or other
  modified_base (8096)..(8096): a, c, t, g, unknown or other
  modified_base (8105)..(8106): a, c, t, g, unknown or other
  modified_base (8113)..(8114): a, c, t, g, unknown or other
  modified_base (8124)..(8124): a, c, t, g, unknown or other
  modified_base (8146)..(8146): a, c, t, g, unknown or other
  modified_base (8165)..(8165): a, c, t, g, unknown or other
  modified_base (8168)..(8168): a, c, t, g, unknown or other
  modified_base (8172)..(8172): a, c, t, g, unknown or other
  modified_base (8179)..(8179): a, c, t, g, unknown or other
  modified_base (8185)..(8186): a, c, t, g, unknown or other
  modified_base (8203)..(8203): a, c, t, g, unknown or other
  modified_base (8214)..(8214): a, c, t, g, unknown or other
  modified_base (8223)..(8225): a, c, t, g, unknown or other
  modified_base (8230)..(8230): a, c, t, g, unknown or other
  modified_base (8235)..(8240): a, c, t, g, unknown or other
  modified_base (8242)..(8242): a, c, t, g, unknown or other
  modified_base (8246)..(8246): a, c, t, g, unknown or other
  modified_base (8249)..(8250): a, c, t, g, unknown or other
  modified_base (8253)..(8253): a, c, t, g, unknown or other
  modified_base (8262)..(8263): a, c, t, g, unknown or other
  modified_base (8274)..(8274): a, c, t, g, unknown or other
  modified_base (8283)..(8283): a, c, t, g, unknown or other
  modified_base (8290)..(8290): a, c, t, g, unknown or other
  modified_base (8292)..(8295): a, c, t, g, unknown or other
  modified_base (8298)..(8307): a, c, t, g, unknown or other
  modified_base (8309)..(8309): a, c, t, g, unknown or other
  modified_base (8311)..(8314): a, c, t, g, unknown or other
  modified_base (8316)..(8317): a, c, t, g, unknown or other
  modified_base (8326)..(8328): a, c, t, g, unknown or other
  modified_base (8330)..(8331): a, c, t, g, unknown or other
  modified_base (8337)..(8337): a, c, t, g, unknown or other
  modified_base (8340)..(8340): a, c, t, g, unknown or other
  modified_base (8343)..(8345): a, c, t, g, unknown or other
  modified_base (8350)..(8352): a, c, t, g, unknown or other
  modified_base (8355)..(8358): a, c, t, g, unknown or other
  modified_base (8363)..(8363): a, c, t, g, unknown or other
  modified_base (8366)..(8367): a, c, t, g, unknown or other
  modified_base (8370)..(8370): a, c, t, g, unknown or other
  modified_base (8377)..(8384): a, c, t, g, unknown or other
  modified_base (8388)..(8389): a, c, t, g, unknown or other
  modified_base (8394)..(8394): a, c, t, g, unknown or other
  modified_base (8396)..(8396): a, c, t, g, unknown or other
  modified_base (8398)..(8399): a, c, t, g, unknown or other
  modified_base (8401)..(8403): a, c, t, g, unknown or other
  modified_base (8405)..(8406): a, c, t, g, unknown or other
  modified_base (8408)..(8409): a, c, t, g, unknown or other
  modified_base (8434)..(8556): a, c, t, g, unknown or other
  modified_base (8767)..(9072): a, c, t, g, unknown or other
  modified_base (9127)..(9129): a, c, t, g, unknown or other
  modified_base (9172)..(9303): a, c, t, g, unknown or other
  modified_base (9547)..(9984): a, c, t, g, unknown or other
  modified_base (10111)..(11304): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtacagttccaattgatgaatgcgccgaggncnnnaatgattgnnnnnngncngcnnnttgcangganannnannanngntatnnntgtnnntgnccnnaannntnnntngannnttcnncnnanccannnnannnnccnggncgnnnntgncgaaaagtggtcaatgaatgcctaaatccccttcnnaatgattgnnnncnaantgccnnntgcnangatnnnccnnnnggntncanntgnnnntgnnnnnnnnnntnngtngannntnnnnnnnnnnnngnnngnnatnnngnnnnannnnnnnntnnnnnnntgnangaatgnncnnnngnnnngnncnantgcnnnnnannngctnnttgcnannannngacccacggattccggtgtcgatgccctccaggcttcattgacaattcgcccgatgctcaacgtccggggagactttgcttcccttcatcccttgaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaatccatgtcaagattattcnctgaatgattgngatccantngccnnntgngacanngannngcccgnnnnntnnnnntgnanntgnccnncnnnntnngnngannnnnncccggannnnnatnttcccggcagaaaatgcnntnntnnnntgaatgaatgtgccctgggnnngaangattgcgatccatntgcngnttgcgangatnnnccccncggctatcnntgccgatgcccnccnggctacgttgatntgtcnccggatgcncnnaannnncccggcagantttgcaaaaaannnnnnnnnnnnnnnnnnnnnnnntgttcgccggatgccctttgcgaggacacccccggtggctatcaatgccgttgcaatcaaggcttcaaagaccttcgaccggaagcccggagnccttccggccgtctttgcaagcaaatggtcaatgaatgcgccagaganttgaattcntgcgacaaaaatgcaaaatgcacagatgagganganggntatcgatgcgaatgcaaaccaaattatgccgacnnnnnnnnnnnnnnnnnnnnnnnnnnnnnnnnnnnnnnnnnnnnnnnnnnnnnnccggatgcccctgaatgcgatgtgaatgaccccatgagttgtgacaaacggaaacatgaagtctgcctattcatgagcggcaattatcgatgcgcatgcccgaatggatatagccgattgccggatggccgnnntttantggtcaatgaatgcgcnaaaccnnatttgaatgattgntncnaaaatgcaaaatgcaaagatnaggacgaaggctatacatgcaaatgcaaaccagattttgtngatgnnngtccngaggaaaggcccggccgaatttgccgaccnctngtgaatgaatgcgcnaaacnaaanaaaantaanntngattgttatccgaatgcnntntgcaaggacacccccganggctatacttgcanatgcccaccaaattatgtnganntttccncnganccagtgaatcgaccnggccgtcgntgnattgnagtggtcaatgaatgtgcngatccanccctnaatgattgctancnaaatgccnnttgcgagganncacnggatggctanatttgcaaatgtnnanctggctatgtngatgtntnnccgnatcccggncnnaatcccggcagaaaatgcaaaaaattggtggatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacatgattgttcgccgaatgccctttgcgaggacacgcccgaaggctatnaatgccgttgcaatcaaggcttcgtngaccttngaccggannnncngnatagncctggccgtntttgcaancaantggtgaatgaatgcgccnaannggagaannnttgcnacncaaatgcaaantgcatngangnggacgaaggctntgcatgcgaatgtnaaccagattttgtcgacatttccnnncaanacnnnaaaatgccgggnagnngttgtnnanatgcnntnaatgaatgnttnnancccaaacngaatgattgctntcnnaatgccgantgcgaggattnacccgagggnttcncttgnatttgtcangntggattngtngacntttccnnnnannangnnnnnnnnccnggcngaanatgntcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacgctttgtcagcgattttgttgaattattnnnnattnnannnnnnaananncnngttggcctnatccaatattcngatcaaattcggcatgaattcnatttnaatcantntnccgataaacnntcnctgctnnnngccntnnnccanacncaatatttnactggnttgaccaggactggngcngccatccaacatatggtnnnngagggattnncnganngncgtggngnnnggccnnnctccnnngnngtnnnncgtgtggcnntngtgatnacggatggcngnagtcangataatgtgacggaaccggccaaggctgcccgcgacatgcgagtcaacatttttgccattggcgtcactgatcatgttttggccgccgaattggaggcaattgccgantctccacaacgttggttttacgtggatnnnnnnnnnnnnnnnnnnnnnnnnnnnnnntcaaaggtccaaaaattggcatgcccttcaccacctcgtnnnccacctccatctcccaccggttgcagcattgaggcccaaactggatgcgatcgaacgcgaaatgaagtgtgcgaattggtgaaccgaaagccaacgtgcaaatgtccggatggattcgcattgaatccactgacgaagacttgtggcgggatttatgtaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacgggaaaatgcattttgccgggttcctgcgatccaaccgaggatcaaccttgcgatgtgcgcaaaagggaaagatgcctttcttctggccaataccacgtttgccaatgtttgcccacagaaaaaaggcatccggcaactgaaatttgctgncgcaatgaatgcacacaaantttgcacgattgnnngccnaatgcaaattgcnnnganacggatgaaggctatcaatgccgatgccctcaaggcttcatngaccatngnccggatccaaaggaaaggcctggncgantttgcannncattggtcaatgaatgcgcccaagaattgnatgattgntacccgaatgcaaattgcgaggacacggangaaggctatagatgcaaatgcaaaccagattatgtngatgtntcncccgacncnanaannnnacctggnagtgtttgccgaccattngtggatgaatgcngncnaccnnaacnnaatgattgcnatncgnatgcganntgcatngatttgcccgatggctanacntgtatttgcnnnnnannntnnnnngannnngannaantnnnnnatccnggccganaatgcgtcnanntncnnnnnantgangaatgcacacaagntttgcacgattgcnnnncaaatgcnaattgcnnngaagacactgangaaggctancaatgncgntgnnctcaagnnttcatagacnatagncccgacccgaaaaggcctggnagnctttgcanacctnnattcnttgaannngacgnattcacantgaattcgtgcgantgntcgccnaatgcaanttgcanaganacgcagganggctatngatgnnaatgcncncaanattttgtggacgtttngcccgacccagtgaatngncctggncgtctttgccancctntggtgaatgaatgcgccctnttggannnnaattnctgcnacaaaaatgcaanttgcacgganacncaggacggntatngttgcnnatgcnaaccaaattatgtngangtttcngccgacccagtgaatcgacctgggcgtcgatgtaaaaaantggtgaatgaatgccnacatgacnnaaangattgctccccgaatgcaatttgcanggacacncaggacggatanagttgntnatgnccanaanattntntggatgtttnngccgacccagtgaanngacctgggcgtcgntgtttngcanaggtgnatgaatgcacacnaaanntgcacgattgctcgccgaatgcnaattgcgangatnngnccgaaggctancaatgcagatgcnctcaaggcttcatngancanngtccngangntccgaaaaggcctggcngnctttgcnnncctnnattcattgaannnnncagantggaaangaatnantgcgacaaaaatgcaaaatgcnnagatnngganganggatatcgntgcnaatgcnaaccaaattnngncgacgattcncccnatnnnnnnanncntccnggnngactntgcntnccnaggccaactccacctccggaagagtgccaattgactnnnggtaccggatgcaggacggaattgaatgaagtntgccnantcatgagcggcaattatcgatgcgcatgcccgaatggatatagccgattgccggatggccgttgtctggnngtgaatgaatgcncanatcannatttgnangattgntcncngaatgcngaatgcnangatnaggcngaaggctataaatgccaatgcaatnaaggattcgtggatgtnngtcccnnggaaaggcctggccgtctttgccggcnnctggtgaatgaatgcgccagactnaaattgnatgattgcnacnnnaatgcaaaatgcnangatnnggaggaaggctatcaatgcaaatgcaancaagattttgnngaccaangtccggaaaggcctggccgnntttgcnnncaaatgntcaatgaatgcgccagactnnanntgaatnantgcgacaaaaatgcacaatgcanngatnagnaggaaggctatccatgccnttgcaaaccaggtttcgtcgacctttcnccgganncaagaangccnggccgtctttgccagcaantngtcaatgaatgcgccanaccggaattgaatnattgcgacaaaaatgcaaantgcacagatgaggagganggntatcgatgcgaatgcaaaccaaattatgccgacgttnnnnnnnnnnnnnnnnnnnnnnnnnnnattttaatcgtacaggtgaatgaatgcacncnanntttgcacgattgntcgccgaatgcaanttgcgangacacgcangaaggctancaatgccgatgcantcaaggcttcntngannntngnccggangcgcnnaaaaggcctggcagtntttgcaangaattggtgaatgaatgcagacnaaatttgnangnttgcnanccgaatgcaaattgcanagannnggatgaaggctacanatgcnaatgtnnnccaaattttgtggacgaaagtcccgaccgancgaaaaggccnggaagggtntgcacantnccnnnnncnnntccancnnnnnangantgcagtgcggcggcaatttgtgaaccgcaaggtggcaataaatatcaatgccgttgcaatcaaggcttcaaagaccttcgaccgcaagaaaggcctggccgtctttgcaagcaaatgaatgaatgcgccagattggagttgaattcntgcgacaaaaatgcaaaatgcacagatgagganganggctatcgatgcgaatgcaaaccaaattatgccgacaagnnnnnnnnnnnnnnnnnnnnnnnnnnnnnnnnnnnnnnnnnnnnnnnnnnnnnnnnnnnnnnnnnnnnnnnnnnnnnnnnnccatcgctgaatgattgtgatccaattgccctctgcaaagatttgnnncccgatggctacacgtgtatttgccntccnnnntnngnngancgntcnnnggannnannnnntnnnccnggcngaanntgnnnnctnnnngnnnnnnnntgnnnnnatnnnnnnnnnaannattgcagcaaatttgctgattgcnnnnnnattgatcagcccgaaggntatcaatgcngntgcaatcaaggcttcaaagancnncgtccggannattcaaaaaggcctggccgtctttgcaagcaagtggtcaatgaatgcgccanacnaaanttgaatgattgctaccaaaatgcaaaatgcnaggatnnggangaaggctacacatgcaaatgtnanccaaattttgtggatgaangtccagacccgngnnggccaggnngngtntgccnncntctattgnatgaatgcgccnatccancgatgaatnattgcnatncaaatgctnantgcgangatttgcncgaaggntntcnntgnngttgcnntcnaggcttcanngaccttnngccggaaagncctggccgtctttgcaagcaantggtgaatgaatgcgccanacngganttgaacnattgcnncaaaaatgcaaattgcnaagacaaggangaaggctannnatgcnaatgnnnnnnanattntgnngangaaagtccnncgaaaaggccnggaagggtntgccgantnnnngannnnnnnnnncncnnnnannatgattgcnnncnnaatgcngantgnnnggatnnnccnnnnggatncanntgncaatgtnnnnnnnnattnntggangntnnannnanncnnacgcatcccggtcgactctgcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtactcgatgcctttgccgcccaggcgatggccgtgattcaagtaatcaaaaatgtgtcccaattgaaaggactcctctggcattccgggtgctcagtcgtggtcgccgtccactcgtctattccagtgaatatgctggcccatccacttcggcatatttggaatttgcccaagaatttgaacgtgatttgggcaaagcaattgacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgcgtggccggtgccctttgtggttgtccggatggccagaagagggtccaannngaggatcaatgccgtcccgtggaatcttggctaattccaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggcgcatttgtgtcagcggaagtgaacgaaattctggatccaatggcagtgaatgcctcctgggattcgggcattctcttcaatgcgacaatgcatttccgcaaaggaacagtgaagaatccgcaagatgcttacaatgttttggtgcgatatgccctcgagagaaatggccatcagctgggcaaatccggcctctaccttagcccatatcaacaaaatccattcagcgcatgttttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggacgaatgcacattgggaacggccgactgcgatgcaaaagctatttgcgaagatttgacccacggattccggtgtcgatgccctccaggcttcattgacaattcgcccgatgctcaaaaccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 598 - DNA, 1401 bp, Artificial Sequence
  Description of Artificial Sequence: Synthetic polynucleotide
  modified_base (28)..(30): a, c, t, g, unknown or other
  modified_base (130)..(993): a, c, t, g, unknown or other
  modified_base (1309)..(1401): a, c, t, g, unknown or other
atgggcgattttgtaccaaaatttgagnnncgtaatttggacatgaagccattgggaccgcgtcctttgccaaccgcaggagcaattccagttaaggatgacaaagggcgaattgtcatgaagaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaccgaattcataacatgacggaagaggaacgtcgagaatacatgcgcctgcacccaaaaatgataaccaatgagcagaggaagggaaaatacaaattcttgcaaaagtactaccatcgtggtgtgttcttcttggacaaagaggacgaagtgctgacgaggaattttgccgaagctacgggtgaagatgtttttgacaaatctgttctgccaaaagtcatgcaggtgaaaaactttggcaaggccagccgatccaaatggacgcatttgacggcggaggacaccacagatcatcagggcgtttgggccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 599 - DNA, 2472 bp, Artificial Sequence
  Description of Artificial Sequence: Synthetic polynucleotide
  modified_base (1)..(1263): a, c, t, g, unknown or other
  modified_base (1663)..(2472): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggttttctacatcgaacaagtcgccgtgattgaacgcaacggactccctcatcgtgtctcattcgccggacctccccgtgacgtcatcatcgatggggtggcacaccgaatggcatttggcgagcagaagcaagtcctcattgacggtgaagtgcatttgctcacattcggtgcaccctcgcgtgaactctacatgggccattacccgttcaagggcgcattcggcgggccacccatcattgccacaatcaacgggcgacgacacgaaattcgattgtgtggcccaccgcccgaagtgaggattgacccggagccaagctatgaactgatgcgacatatgcccgcaattcgtcagcaacaaccgcaagcacaaatctcaccaaaaattgagccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 600 - DNA, 2178 bp, Artificial Sequence
  Description of Artificial Sequence: Synthetic polynucleotide
  modified_base (1)..(804): a, c, t, g, unknown or other
  modified_base (958)..(1683): a, c, t, g, unknown or other
  modified_base (1726)..(1728): a, c, t, g, unknown or other
  modified_base (1912)..(2178): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaattggacgtgaagcggaaaattgcctccgaatttttgaggtgttcaccggcgaaatcaaaaaggcattctccccgtcgggcaagtcgaccacaaatcgcctccatgaatggccctttgtgaaatggagtgcggatgaacggttctttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggctttctgggacccaactggccgctattttgtcacgtgcnnnacttttggtgggaaaagtcgctacgaaactggctaccgaattcattcattcatgggccgagaattgcttcggaaaacggtcgattcactgcttcgcttcaaatggcgccctcgtcccccagtgcaattgcccgaacaaaaagtgaaagacatccgaaaatcgctgaagcaacagtcggcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 601 - DNA, 711 bp, Artificial Sequence
  Description of Artificial Sequence: Synthetic polynucleotide
  modified_base (1)..(33): a, c, t, g, unknown or other
  modified_base (364)..(711): a, c, t, g, unknown or other
nnnnnnnnnnnnnnnnnnnnnnnnnnnnnnnnnaatcccacaatgaccggttcaacggtgatggcaatttgttacgacggaggtgtggcagttgccagcgaccgaagtgttttctatgggaaaatggaacgcatccgtaattcaactcgccaatattgtgtcaatccatattgcttggtggtgttctccggtgattttgccgactttcaatggcttcaaaatctgattgaacgaaaacaaatggatcttcagcaagggaaccaatatttgaaaccaaaaatggtgcattcaatcctgacaacacttttctaccaacgtcgctcaaaaatgaatccaatttggaacacaattgttgtttgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 602 - DNA, 1719 bp, Artificial Sequence
  Description of Artificial Sequence: Synthetic polynucleotide
  modified_base (1)..(63): a, c, t, g, unknown or other
  modified_base (223)..(225): a, c, t, g, unknown or other
  modified_base (277)..(324): a, c, t, g, unknown or other
  modified_base (420)..(420): a, c, t, g, unknown or other
  modified_base (559)..(573): a, c, t, g, unknown or other
  modified_base (886)..(1353): a, c, t, g, unknown or other
  modified_base (1642)..(1719): a, c, t, g, unknown or other
nnnnnnnnnnnnnnnnnnnnnnnnnnnnnnnnnnnnnnnnnnnnnnnnnnnnnnnnnnnnnnnaaagacatggccaaacatcaatcgaacatggccgccgcaacagcggacaaaatcaatcagcatgcggtcaacaaaagggaagatccatccaatccgttggaatattaccgaatgcgggttgaaatgatcgagggaaggagggcagccggtgaaaatccannnccacacaaattcgatgtgtcaatctcgctgcaacattttatcgaaaaatacnnnnnnnnnnnnnnnnnnnnnnnnnnnnnnnnnnnnnnnnnnnnnnnnggtcgggtatatttgaaacgtgaacaagggaccagacttattttctacgacttgcatggagagtgtaaaaaaattcaagtgctggccaatgcaaantataacatgggcattgatgatttcctggtcgtccatgaccgaatcaaacgcggcgacgtgatcggtgttgaaggccatccatctcgatcaaataccggcgaactcagcattgtgccaacttctgtccaattgctcactnnnnnnnnnnnnnnnttgccgcataaacattatggcataaagaacattgatgtccgctaccgaatgcgctatttggatttgcttgtgaatcaggatattcgagccaaattcgtcacccgctccaaaatcatcacatttttgcgaaagtatttggacaatctcggtttcctggaggtggagacgccaatcatgaatcaaattgccggcggtgccacagcaaaaccattcatcacataccacaatgaattggagatgaacctgtatttgcgagttgcacccgaactttaccataagatgttggttgttggtggaattgaccgcgtctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggccaaatggcatcgttccgtcccgggactgaccgaacgctttgaattgtttgcggtcacaaaggaaatttgcaatgcctacacggagctgaacgacccgctcactcaaagagcccgttttgagcaacaagcgaaagacaaagaggccggtgatgaggaagcccagctggtggacgagaatttctgcaccgcattggaatatggattgccaccaaccgcaggatggggaatgggaatcgatcgattgagcatgatcctcaccgacagccataacatcaaagaggtcnnnnnnnnnnnnnnnnnnnnnnnnnnnnnnnnnnnnnnnnnnnnnnnnnnnnnnnnnnnnnnnnnnnnnnnnnnnnnn

SEQ ID NO: 603 - DNA, 1068 bp, Artificial Sequence
  Description of Artificial Sequence: Synthetic polynucleotide
  modified_base (1)..(501): a, c, t, g, unknown or other
  modified_base (619)..(1068): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgttcgttcgaccaatccaaccacatttatgtcaaatatgctttatgcatgttcaattctttatcgaacaaaattgccattttttctcgtcctgaacaaggccgatgtggtgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 604 - DNA, 2904 bp, Artificial Sequence
  Description of Artificial Sequence: Synthetic polynucleotide
  modified_base (1)..(708): a, c, t, g, unknown or other
  modified_base (850)..(1194): a, c, t, g, unknown or other
  modified_base (1330)..(1530): a, c, t, g, unknown or other
  modified_base (1545)..(1545): a, c, t, g, unknown or other
  modified_base (1551)..(1553): a, c, t, g, unknown or other
  modified_base (1578)..(1578): a, c, t, g, unknown or other
  modified_base (1587)..(1587): a, c, t, g, unknown or other
  modified_base (1590)..(1590): a, c, t, g, unknown or other
  modified_base (1593)..(1593): a, c, t, g, unknown or other
  modified_base (1602)..(1603): a, c, t, g, unknown or other
  modified_base (1605)..(1605): a, c, t, g, unknown or other
  modified_base (1612)..(1612): a, c, t, g, unknown or other
  modified_base (1614)..(1615): a, c, t, g, unknown or other
  modified_base (1620)..(1620): a, c, t, g, unknown or other
  modified_base (1623)..(1623): a, c, t, g, unknown or other
  modified_base (1629)..(1629): a, c, t, g, unknown or other
  modified_base (1632)..(1633): a, c, t, g, unknown or other
  modified_base (1640)..(1640): a, c, t, g, unknown or other
  modified_base (1648)..(1648): a, c, t, g, unknown or other
  modified_base (1650)..(1651): a, c, t, g, unknown or other
  modified_base (1657)..(2436): a, c, t, g, unknown or other
  modified_base (2566)..(2904): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccggcggtgccgttgcccgtgatggtcgaatcagaattggggatgtgattctgaaagtgaacacaacggatacagtcgatgttcctcatcaagtggccgttgatgcgttgaaaagttcaggcagtgttgttcgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgccgttgcccgtgatggtcgaatcagaattggggatgtgattctgaaagtgaacacaacggatacagtcgatgttcctcatcaagtggccgttgatgcgttgaaaagttcaggcagtgttgttcgattggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgactttgcgaaanggcgannntggtcttggcttcaacattgttggnggcgaaganggnganccaatttanntnagccatntnntgccnggnggtgcngcnnatttgantggaaatntnngaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgattattatttcgtgagcaaaccagaaatggacagggacatcaaaaacaatttgttcatcgaggctggccaattccagaataatctttatgggacaagcattgcatcggtgcaggaagtagccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 605 - DNA, 1974 bp, Artificial Sequence
  Description of Artificial Sequence: Synthetic polynucleotide
  modified_base (1)..(177): a, c, t, g, unknown or other
  modified_base (226)..(228): a, c, t, g, unknown or other
  modified_base (376)..(498): a, c, t, g, unknown or other
  modified_base (634)..(879): a, c, t, g, unknown or other
  modified_base (1039)..(1398): a, c, t, g, unknown or other
  modified_base (1546)..(1974): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaacgggtgactccatctgttgtgtcattgactgccgaaagtggtnnntggttggttggcaatgctgcaaaggaggaaatgaacaaaaatgtcaagaacacggtctacgatgcgaaacgcatgttgggcaaagcatttttgcatccggacattcaaaaactccgagagaattggcaatttgaattggtggataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcatcgtgctgtgattacggtgcccgccaaatttgaaatgccacaaaaggccgcggttttggaagctgccaaattggctggattaaccgtagtccgattgatcactgaaccagcagccggttggtttttttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaaaaggcaaaacgtggcctctccgttcaacatcaagtcaagctggaagtggaatcattgatcgatggcgaagacttctccgaaacgctgactcgcgccaaattcgaggagctcaacatggatttgttccgaggcacattgaaaccagtgcaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatgaaggggaacgcaaattggcattggaaaacaaccatcttggcaatttcactctctacgatcttccaaaaagagcagccggagatgtgtcgatcaaagtgaaattgtcaattgatcgagacgggattctgcatgctcaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 606 - DNA, 1833 bp, Artificial Sequence
  Description of Artificial Sequence: Synthetic polynucleotide
  modified_base (1)..(51): a, c, t, g, unknown or other
  modified_base (138)..(138): a, c, t, g, unknown or other
  modified_base (202)..(657): a, c, t, g, unknown or other
  modified_base (829)..(1389): a, c, t, g, unknown or other
  modified_base (1546)..(1547): a, c, t, g, unknown or other
  modified_base (1549)..(1549): a, c, t, g, unknown or other
  modified_base (1551)..(1552): a, c, t, g, unknown or other
  modified_base (1554)..(1558): a, c, t, g, unknown or other
  modified_base (1561)..(1562): a, c, t, g, unknown or other
  modified_base (1566)..(1566): a, c, t, g, unknown or other
  modified_base (1669)..(1670): a, c, t, g, unknown or other
  modified_base (1689)..(1689): a, c, t, g, unknown or other
  modified_base (1692)..(1692): a, c, t, g, unknown or other
  modified_base (1698)..(1698): a, c, t, g, unknown or other
  modified_base (1701)..(1701): a, c, t, g, unknown or other
  modified_base (1728)..(1728): a, c, t, g, unknown or other
  modified_base (1825)..(1833): a, c, t, g, unknown or other
nnnnnnnnnnnnnnnnnnnnnnnnnnnnnnnnnnnnnnnnnnnnnnnnnnncgaattgccattgtcaatccggacaggtgcaaaccgaagaattgtggtcaaccttgcaagaaaaactgcccagttgttagaacagtnaaacaatgcattgtggtcgaaccaacatcgaaaattgctgaaatctccgaagttctctgcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctcgaccgtgaggtcaatcaattgtccggtggcgaattacaacgatttgcaatttccgttgcagcaattcaacgagccgatatttacatgtttgatgagccttcaagttatttggacgttaaacaacgactgactgccgcccgagtaatccgtgaactgcttaccgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctcgaccgtgaggtcaatcaattgtccggtggcgaattacaacgatttgcaatttccgttgcagcaattcaacgagccgatatttacatgtttgatgagccttcaagttatttggacgttaaacaacgactgactgccgcccgagtaatccgtnnantnntnnnnnatnnaaanaagactgcatttgttgttgaacacgacttcataatgagcacatatttggcagatcgggtcattgtttttgatggacagccggcgattaaagcaaatgcaaatnnaccacaacaattggttacnggnatgaancgntttttgagccaacttgacatcacattncgacgtgacaatgaaagcaatcgaccaaggattaataagaaagattctcaattggatgttgagcagaaaaaatcgggagattacttttaccttgatnnnnnnnnn

SEQ ID NO: 607 - DNA, 2433 bp, Artificial Sequence
  Description of Artificial Sequence: Synthetic polynucleotide
  modified_base (1)..(18): a, c, t, g, unknown or other
  modified_base (235)..(681): a, c, t, g, unknown or other
  modified_base (1060)..(1233): a, c, t, g, unknown or other
  modified_base (1890)..(1890): a, c, t, g, unknown or other
  modified_base (2071)..(2433): a, c, t, g, unknown or other
nnnnnnnnnnnnnnnnnncaaaaggacgaaaaaactaagcgaaatgaagagcttgcaacggccatccttcagaacaaaccaaaaccgaatcgccttattgtcgattcaaacaccggtgatgacaacagcaccgttggactctcgcaagcaaagatggatgaactcaacctgttccgtggtgataccgtcattctgaaagggaagaagcgccgggagactgcatgcgttgtgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtcgaacatcccgaaatgttcctcaaatttggcatgcaaccgtcgcgtggtgttctcttctatggaccaccgggatgcggaaaaacattgttggccaaagcaattgctcgcgaatgccaggcaaatttcatcagcatcaagggacctgaattattgacaatgtggtttggcgagtccgaggccaatgttcgagatgtgttcgacaaagcacgtgccgcagccccttgcatccttttctttgatgaacttgactcaattgcaaaatcacgtggtggcaacctgggcgatgcggcggaccgtgtcatcaatcaagtgctgaccgagatggacggtatgggatcaaagaagaatgttttcatcattggcgcaactaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggcgctgatttggctgcactttgctcggaggctgcaatgcaacaaattcgcgagaaaatggagatcattgatttggaggccgaacaactcgacgccgaagttctcaaccaattggcggtcactatggatgatttccagtttgctctcggaaagaacagtccttcggctcttcgcgaaactgttgtggaaacaccaaatgtcacctgggaagacatcggcggtttggaaaatgtgaaacgcgaattgcaggaattagtccagtatccagtcgaacatcccgaaatgttcctcaaatttggcatgcaaccgtcgcgtggtgttctcttctatggaccaccgggatgcggaaaaacattgttggccaaagcaattgctcgcgaatgccaggcaaatttcatcagcatcaagggacctgaattattgacaatgtggtttggcgagtccgaggccaatgttcgagatgtgttcgacaaagcacgtgccgcagccccttgcatccttttctttgatgaacttgactcaattgcaaaatcacgtggtggcaacctgggcgatgctggtggtgcggcggaccgtgtcatcaatcaagtgctgaccgagatggacggtatgggatcaaagaagaatgttttcatcattggcgcaactaaccgncctgatattatcgattcggcaattcttcgtcccggcagactggaccaattgatctacatcccgcttccggatgagccaagccgattggccatcttcaattcatcactgcgcaaaacgccgattgccaccgatgtggatttgtcctacctgtccaaagtcaccgtgggcttctctggcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 608 - DNA, 2949 bp, Artificial Sequence
  Description of Artificial Sequence: Synthetic polynucleotide
  modified_base (1)..(939): a, c, t, g, unknown or other
  modified_base (1135)..(1593): a, c, t, g, unknown or other
  modified_base (1807)..(2949): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaggcccccagggcttggtccagaaggcccggatggggctgaatcattcccaacgaatgttcaagtttgcccgcattgtggcttcagttgttcctccaaattccactataattcgcatatgaacacccacacaacccatcaatgcccaatgtgcacttatcagtcccggacggagggccgactcaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgggcaaaccaaaacaatacatttgcaaacaatgccaacacatcagccggagcaaaaaggaacaatgggcgcatgccaaattgcacattccaaagcaaaaacaattaacctgcgaattatgcgattttgtgaccgaatataaacatcatttggaatatcattatcgaaatcataatggccaaaaaccgttcaaatgcaatacatgcgcctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 609 - DNA, 1296 bp, Artificial Sequence
  Description of Artificial Sequence: Synthetic polynucleotide
  modified_base (1)..(105): a, c, t, g, unknown or other
  modified_base (191)..(192): a, c, t, g, unknown or other
  modified_base (406)..(573): a, c, t, g, unknown or other
  modified_base (775)..(1296): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagagccggcgttgagttccaaaacagcgcaattcaagaagggaacaggagggagggcaagcttctcgggcaatgttataacagnntttggctcgagtggcttcaccggactcagcgtggtgaacagattggccaaacagggcaatcaactcataattccctatcgttccgatccatacttcatcaaagagcacaaagtggccggcgaattgggacaaattctgttcttcccattcgaactaaaagatgagaacaccattcgacgggcagtcaaatacagcaatgttgtggtcaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattcctgaaaaccaaaggcctaggcgagttggccgtccgtgaagaattccctgcagccaccattgttcgcccatcggtgatgtacggtgaaaaggatttcttcatctatatgatgatgtcggcctacggcggatgccgcccttggatgggtttacgtctacaaagggggcatggcatctacaaaatgccaacatttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 610 - DNA, 1125 bp, Artificial Sequence
  Description of Artificial Sequence: Synthetic polynucleotide
  modified_base (1)..(840): a, c, t, g, unknown or other
  modified_base (949)..(1125): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagaaatgtgacgtggatttgcgcaaaacgctctatcaaaatattgttttgagtggaggatcgacaatgttccaaggatttggcgaccgacttttaaccgaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 611 - DNA, 3699 bp, Artificial Sequence
  Description of Artificial Sequence: Synthetic polynucleotide
  modified_base (1)..(3): a, c, t, g, unknown or other
  modified_base (48)..(48): a, c, t, g, unknown or other
  modified_base (121)..(183): a, c, t, g, unknown or other
  modified_base (309)..(310): a, c, t, g, unknown or other
  modified_base (313)..(318): a, c, t, g, unknown or other
  modified_base (320)..(321): a, c, t, g, unknown or other
  modified_base (324)..(324): a, c, t, g, unknown or other
  modified_base (326)..(326): a, c, t, g, unknown or other
  modified_base (328)..(328): a, c, t, g, unknown or other
  modified_base (331)..(331): a, c, t, g, unknown or other
  modified_base (333)..(336): a, c, t, g, unknown or other
  modified_base (338)..(338): a, c, t, g, unknown or other
  modified_base (340)..(340): a, c, t, g, unknown or other
  modified_base (345)..(345): a, c, t, g, unknown or other
  modified_base (350)..(350): a, c, t, g, unknown or other
  modified_base (352)..(354): a, c, t, g, unknown or other
  modified_base (358)..(360): a, c, t, g, unknown or other
  modified_base (376)..(376): a, c, t, g, unknown or other
  modified_base (378)..(378): a, c, t, g, unknown or other
  modified_base (381)..(381): a, c, t, g, unknown or other
  modified_base (392)..(393): a, c, t, g, unknown or other
  modified_base (396)..(396): a, c, t, g, unknown or other
  modified_base (401)..(401): a, c, t, g, unknown or other
  modified_base (410)..(412): a, c, t, g, unknown or other
  modified_base (414)..(415): a, c, t, g, unknown or other
  modified_base (418)..(418): a, c, t, g, unknown or other
  modified_base (421)..(425): a, c, t, g, unknown or other
  modified_base (427)..(430): a, c, t, g, unknown or other
  modified_base (432)..(432): a, c, t, g, unknown or other
  modified_base (435)..(435): a, c, t, g, unknown or other
  modified_base (438)..(440): a, c, t, g, unknown or other
  modified_base (442)..(442): a, c, t, g, unknown or other
  modified_base (444)..(449): a, c, t, g, unknown or other
  modified_base (452)..(452): a, c, t, g, unknown or other
  modified_base (456)..(457): a, c, t, g, unknown or other
  modified_base (459)..(464): a, c, t, g, unknown or other
  modified_base (468)..(468): a, c, t, g, unknown or other
  modified_base (471)..(471): a, c, t, g, unknown or other
  modified_base (474)..(475): a, c, t, g, unknown or other
  modified_base (479)..(481): a, c, t, g, unknown or other
  modified_base (483)..(483): a, c, t, g, unknown or other
  modified_base (486)..(487): a, c, t, g, unknown or other
  modified_base (498)..(498): a, c, t, g, unknown or other
  modified_base (564)..(564): a, c, t, g, unknown or other
  modified_base (627)..(627): a, c, t, g, unknown or other
  modified_base (910)..(1677): a, c, t, g, unknown or other
  modified_base (1761)..(1761): a, c, t, g, unknown or other
  modified_base (1995)..(1995): a, c, t, g, unknown or other
  modified_base (2031)..(2031): a, c, t, g, unknown or other
  modified_base (2040)..(2040): a, c, t, g, unknown or other
  modified_base (2256)..(2256): a, c, t, g, unknown or other
  modified_base (2446)..(3198): a, c, t, g, unknown or other
  modified_base (3423)..(3423): a, c, t, g, unknown or other
  modified_base (3502)..(3699): a, c, t, g, unknown or other
nnngcattattaaagaaatttgagtcaaaaagtgccagagttaaaggnatttcgttccatccgacaagaccatgggtgttggcatctttgcacagtggagtgatccaactttgggattatnnnnnnnnnnnnnnnnnnnnnnnnnnnnnnnnnnnnnnnnnnnnnnnnnnnnnnnnnnnnnnncattcgcaacaaccaatttttgtttcaggcggagatgattataaaatcaagttgtggaattacaaacaaagaaaatgcatttttaccctcctcggccatttggattatattcggaccactttcttnnacnnnnnncnnccntngnttntnnnngntnccgangatcnannngtcnnnttgtggaattacaaananagnaaatccattgnnacnctccncggccattnnnannatnttnnnnncnnnntnttncannnanannnnnnatngatnntnnnnnnttcngangannaaannntncgnntttgggacatnagcggtctgcggaagaagaatacggcggcgggtggcggtttgggtggtccgtccagtggaatgganaccgaactgttcggccaaccggatgtggtcgtcaaacatgtgttggaaggacatgaccgagcngtgaattgggtctcattcaactcttcgctccccttgcttgtttcgggtgccgatgatcgacaagtcaaattgtggcgttacaacgagaacaaagcttgggaagtggactcgtgccgcggccattacaacaatgtttcatgcgtcattttccatccaaaggcggaattgatcctatccaattcggaggacaaaagcattcgagtttgggacatgcagaagagaacttgtcttcagaatttccgacatgagaatgatcgcttctgggttttggccgcccatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgaccatggaattattcgtacaatcgacattcccgtctacattctggccattcgcggcaatcgattatattgtttgagcagngaagcctccccaattgaattgacaattgattcgacggaatatcgtttcaagctggccctaatccatcgccgttatgatgaagtgctgaacatggttcggagtgcgaatttggttggccaatccatcattgccttcctgcaaaagaagggatatccggaagtggcgctgcattttgtgaaagatgaaaaaactcgatttggccttgcactggaatgtggaaatcttcagttggcnttggaagcggccaaacaattggacgataaggccgcntggacagcnttgggcgaggcggcattgatgcaaggaaatcatcaaattgtggaaatggcctatcaacggacgaaggattttgaacggctggcattcctctatttaatcactgggaacatggagaagctgaagaaaatgcaaaaaattgcccaaatccgaaaagatgtccatggccaattccaatgtgctctgatgcttggagatgcggaagaacggacaaaaatnctgaaagaattgggccaattgccgttggcatatttgtccgcaaccacaaatggcttagaagaggaagccgcccaattgagtgcagaattggagcaaaaacacattcaaataccggacacaaatccaaatgcccaaccaattcatccaccaaagccaattaatccactggttgagaattggcctcaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagaatatttggttggcctcctcctggaaatggcccgcaaagagttgccacgtgaatccgtggacgatgcaaaaaggaatttggaaatggccgcctatttcacccattgcgaaattcaaccaattcacaaaattttgacacttcgaacggccgcaaatttaagtttcaaaaataaacaaatgcgacattgtgcatcattttgccggcgatgcattgaattgganccaaaaccggaaatagccgcccaaatgaggaaaatgttggccgtggccgaacgtgacaataataatgcatttgaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 612 - DNA, 528 bp, Artificial Sequence
  Description of Artificial Sequence: Synthetic polynucleotide
  modified_base (1)..(135): a, c, t, g, unknown or other
  modified_base (220)..(528): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgatgaccgccccgatttttggtttccttcagtgagattccgcgcaaacgatgcactcataacgccgattcgggagaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 613 - DNA, 2163 bp, Artificial Sequence
  Description of Artificial Sequence: Synthetic polynucleotide
  modified_base (208)..(720): a, c, t, g, unknown or other
  modified_base (793)..(795): a, c, t, g, unknown or other
  modified_base (811)..(816): a, c, t, g, unknown or other
  modified_base (1009)..(1341): a, c, t, g, unknown or other
  modified_base (1441)..(1647): a, c, t, g, unknown or other
  modified_base (1834)..(1872): a, c, t, g, unknown or other
  modified_base (2107)..(2112): a, c, t, g, unknown or other
  modified_base (2152)..(2163): a, c, t, g, unknown or other
atggctcatctcatcgatggcttcgttgtcaatgatgccaaatggaaacttggcattttcgtcaccgatttgaacatttcgcgtgagattttggtcaaaggggatctcacaattggcaatttgatgatgcaattggtcgagcaaattggcgagaaccaagactggagtgatcatgcattatggtggccggatagacgcaaatggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggagccgggactttgtgagggactggacgatgaattcttcgaccaaaatttaatcaattcgccaaaaatcnnncccagccgagattccnnnnnnttcaagccccaaaacttaatggagaaggcggcattgaacagaggatggcttgattcatcacggtcactaatggagcagggcatttgcgagggggacacggtgctgttgcgtttcaaatttatgaccttcttcgacatcaatctaaaatatgaccccgtccggatcaatcagctttatgagcaggcaaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactcggccattattatatgaagggctgtgaagtgagccaagagttgagtgttgcgcaaggcaaatttcacatcaaattacaattgccaagcagtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccaactcccatccgatttcaatgtggaggaatatgcctccaacgataagttaaaaaataaaaatttcaatttaaagttgcaacatcgaatttcggatgcccactcaaatgtccgcagtttgagttgcagagaagcaaaattgcaatatattcgaaattgggaggcattaccagaacatggccttnnnnnnnnnnnnnnnnnnnnnnnnnnnnnnnnnnnnnnngaattgattgcggtcacccataatcgcataatgaaagtgaacagtgagaatggcgaatccacgaagacatggcgctttgcgggcatgaaaaaatggcatgtgaattgggaaattcgccacatcaaagtgcaattcgacacggaggacattgagttcaaaccactttcggccgattgcaaggttgttcatgagttcattggcggttacattttcatgtcactccgcagcaaggacnnnnnncagaacctggacgaagaaagatttcatcaattgactggtnnnnnnnnnnnn

SEQ ID NO: 614 - DNA, 3279 bp, Artificial Sequence
  Description of Artificial Sequence: Synthetic polynucleotide
  modified_base (1)..(1299): a, c, t, g, unknown or other
  modified_base (1459)..(3279): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgtcacgagaaaattgttcccgttcttctctcccaaatgaccgacctttcaaatccgcgtgtcgctgcacatgccgctgccgcaatggtcaatttttgtgaggattgtccgaagaacatcatcagcatttatttgcctgctgtaataattaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 615 - DNA, 1149 bp, Artificial Sequence
  Description of Artificial Sequence: Synthetic polynucleotide
  modified_base (235)..(237): a, c, t, g, unknown or other
  modified_base (316)..(318): a, c, t, g, unknown or other
  modified_base (949)..(1149): a, c, t, g, unknown or other
atgggcattaaaggactttctttggtcgtttctgatcattgcccaaatgcaataaaggaaaaggaaatgaaagcttattttggccgtataattgccattgatgcttcgatgagtttataccaatttttaattgctgttcgtcaagatggagtccaattgacaaatgcagatggcgaaacaacaagccatctaaatggaatgttttatcgcacaattcgaatgatggaaattggannnaagccaatttatattttcgatggcaaaccacctgaactcaaatcgggcggagctcgacaaaagaatggaaaacgtgcgnnnatgccgaaggaaaattggcgaagcaaggaaaaaggtgacaaagttgcaatggaaaaatttgaacgaagacttgttaaggtcacaaaagaacacagcgaagaatgcaaaaaattgctcaaattgatgggaattcccacaattgatgctccatgcgagggcgaagcacaatgtgcggaattggttcgtaaagggaaagtatatgcaactgcaacagaggatatggatgcgttaacatttggttcccaaatattggtcagacaaatgacattcagcgaagccaagaaaatgccaatcaaagaattttcgcttgaaagaatgctgaaggatatggacatgacgaatgaacaatttgttgacctttgcattttacttggatgcgattattgcggaaatatcaaaggagttggtccaaagaaagcattcgaattgatcaaacaacacaaaagcatcgaagcaatattggaaaatattgatttgaagaaatatcatccgccagaaaattggaaattcaaagaggcacgagaattatttttgaatcctgatgttctcgatgggagcaaaattgagttcacttggaatgagccaaatacaaaggaaattatcgaatttctttgcactcaaaagggattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 616 - DNA, 741 bp, Artificial Sequence
  Description of Artificial Sequence: Synthetic polynucleotide
  modified_base (1)..(66): a, c, t, g, unknown or other
  modified_base (108)..(108): a, c, t, g, unknown or other
  modified_base (330)..(330): a, c, t, g, unknown or other
  modified_base (622)..(741): a, c, t, g, unknown or other
nnnnnnnnnnnnnnnnnnnnnnnnnnnnnnnnnnnnnnnnnnnnnnnnnnnnnnnnnnnnnnnnnntattgccttgtcggaatcggatcttccgagaatttctactgntttcttgaagctgaattggcagatacaattcccgttattcattgcacgattgcgggaatccgaattgttggcagaattacagttggcaatcgccatggccttttagttccaaacgcaacaactgaccaagaattacagcatatccgaaatagtttgccagattccgttcaaattagacgaattgatgaaaggctttccgcattgggcaatgttattgcatgnaatgaccacgttgccattgttcatgcagaaataagcaaagaaacggaacaaacgctcagagaagtcctcaaggtggaagtatttcgacttagccttggcgaaaattcattggttggcacatatgcagcaataacttcgaatggttgtttggtggcagcaaagacgcctcccgaagtgcaacgggaattggcttctctcatccaagtgccggttgtggctggcacaatcaatcggggatcagaattgattggagcgggtgtttgtgtgaatgattggagcgcattttgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 617 - DNA, 927 bp, Artificial Sequence
  Description of Artificial Sequence: Synthetic polynucleotide
  modified_base (1)..(282): a, c, t, g, unknown or other
  modified_base (429)..(429): a, c, t, g, unknown or other
  modified_base (481)..(927): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccagttcaatacaaattgaaattaatacaaggggatgtgataaaaaatgaatggccacagtttgatatttgtgtttcaaatttgccatataaaatctcttcaccatttgtgtttcgactacttcttcaaagaccgttaccaagntatgctgtcttaatgttccaaaaggaatttgctgaccgtcttttggttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 618 - DNA, 624 bp, Artificial Sequence
  Description of Artificial Sequence: Synthetic polynucleotide
  modified_base (334)..(624): a, c, t, g, unknown or other
atggctccccgtggaaataacatgttgcccaatgcgcattttcacaagcattggcaacgtcgcatcaaaacatggttcaatcaaccggcccgcaagcttcgccgtcgtcaggcacgcatggccaaggctgcaaaggttgcaccccgtcctgttgccggattacttcgtcccgttgttcgctgtccccgagcacgttacaacaccaaagtccgacttggccgtggtttcactctggaagaattgaaggccgcaggtttcaccaaatatgaggccaaatcatttggcattgctgtcgactttcgccgtgtcaaccgctctgttgagtctcttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 619 - DNA, 393 bp, Artificial Sequence
  Description of Artificial Sequence: Synthetic polynucleotide
  modified_base (127)..(393): a, c, t, g, unknown or other
atggtgcgcatgaatgtgttagctgatgccctcaagtcgataaataatgctgaaaagcgaggaaaacgacaagttataattcgcccatcgtccaaggtgatcatccgcttcctcaccgtcatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 620 - DNA, 1626 bp, Artificial Sequence
  Description of Artificial Sequence: Synthetic polynucleotide
  modified_base (1)..(273): a, c, t, g, unknown or other
  modified_base (543)..(543): a, c, t, g, unknown or other
  modified_base (586)..(588): a, c, t, g, unknown or other
  modified_base (672)..(672): a, c, t, g, unknown or other
  modified_base (856)..(897): a, c, t, g, unknown or other
  modified_base (940)..(942): a, c, t, g, unknown or other
  modified_base (1024)..(1401): a, c, t, g, unknown or other
  modified_base (1621)..(1626): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgaatccatcggtccatggccaacattcatcattttccttcaaggaattttcaaatcatgatcttcaaatgcttttgcaattctcgctggtcattggcacaaacatgtccgcaatggaggccatccaattggatcatttcctctatgagaacaacattccattcatttatgctcgagtttacggattgttgggctatatgcgattgtctttccgggaacacgtcatttggaatcatcatgaagaaaatgatccattcgatttgagnttggacagtcctttccctgaattgttgaaaatggtgaatgaannnaattttgaagggatgacctatgaacaacataaacacactccatatgtcattttatattttaaagcattggaaatttggaaaagncataagaatgagggtgcgaattatccggagaataattacaaacgttcggaaattttggcaattttaaatgaactacgcaaaccaaatgataaaggattcattgtggatgaggaaaattttgatgaagccaaagcaaatttattgaagagcattggccgaacaaaggtgaatattcgaatccaannnnnnnnnnnnnnnnnnnnnnnnnnnnnnnnnnnnnnnnnnttttggattctttgttccgcacttcgtgaattcattgcccaannnaatcaatatatgccgcattcagggcaacttccggatatgaccagcgattcgaaaagatacactcaattattgggcgtttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaggattcggaattgatggccgtccaagacaaattaattcccaacgaattgctcaatgaaatttgccgttatggaaatgctgaaccccatgtggtggccgcaattttgggtggttgtgtttcgcaggaggccatcaaattgtgcacccatcaatttattcccgtcgacaattcgctcatcatcgacggccattctcaacaatcccatgcatttcggnnnnnn

SEQ ID NO: 621 - DNA, 3243 bp, Artificial Sequence
  Description of Artificial Sequence: Synthetic polynucleotide
  modified_base (1)..(639): a, c, t, g, unknown or other
  modified_base (829)..(834): a, c, t, g, unknown or other
  modified_base (981)..(981): a, c, t, g, unknown or other
  modified_base (984)..(984): a, c, t, g, unknown or other
  modified_base (1005)..(1005): a, c, t, g, unknown or other
  modified_base (1138)..(1233): a, c, t, g, unknown or other
  modified_base (1414)..(1542): a, c, t, g, unknown or other
  modified_base (1599)..(1599): a, c, t, g, unknown or other
  modified_base (1726)..(2154): a, c, t, g, unknown or other
  modified_base (2209)..(2211): a, c, t, g, unknown or other
  modified_base (2326)..(2604): a, c, t, g, unknown or other
  modified_base (2710)..(3243): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattccgacaatgccattgatttatgcgactttgagcactttgcatggttttctcgactgggtgccagttggctatgtttctttaataaatattatttattatttaatttggacatttctcccattccccgttttccgttccattgccgtccaatgccttgtcgaaatctcctcaatttcaatggaannnnnnaaccaacaatatgggccaaaactggtgtttatgctgaaaacagtgatggaaacaatttccactcaacttccactggacgtcgacctcgcggccaattatgcaaatggaaataatgatgaacagaaatttgtgtccaattttgcccanctncttggcacattcctcaaagancattccggactggtggaagtactggtgaacacaccggacgaagatcaacgaattttgaaacaagcgcatttgttggcgttgaaatatttgctgaagattagtcaagtggaggatgtggaagtgttcaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcaccccgtcgtaaactctatgccgatgttttgtccgaattgcgtgtgctgatgatcagtcgaatggccaaaccggaggaagtaattgttgtggtgaatgagaacaatgaggcggtgcgagaattggtcaaagacaccgattcggtggttctctacaaaacaatgcgcgaaacattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggtgcaatgcatgaggacgacgagaagcgcttcttggtcaccgttatccgaatnttgctgggactttgtgagcaaaaacgcggaaaagacaacaaagcggtgattgcatccaacattatgtacgtggtgggccaatatcccgcttccttccgctgccattggaaattcctcaaaacagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttgaaacgcattttgaacgacatgctcagcgtttaccaagtaatttcggaannntttgaacaaagcagtgaatgacaaggcgaacaagtgcttaaattcccgttgatcaagcaaatgcgtgttgtgaagaaggaaattttgacactgctttccacctggatttcacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttcaatgtgctgatcgcattggcggatgaggtggttggcctcattattcatgcaattgtgtgggccatcaagcatacaatgcgaaatgttgccgaaaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 622 - DNA, 1134 bp, Artificial Sequence
  Description of Artificial Sequence: Synthetic polynucleotide
  modified_base (1)..(354): a, c, t, g, unknown or other
  modified_base (862)..(1134): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgcatcgaaatctacaaaaaccggaaatttacggcaataaagatgcacttttgaaatttcgaatggaattgaatatgaatacggaaaagacgaccaaatttattggagcctcacgtcaactcgtctcaattccattcccatttccgagtaaagaaaaacggacgattttggcatttgcaccggacaaagaaatgcaagaggaggcattggccgcaggcgccgatttggcattgggtccgatgccatcaaaaaggattttgaaaggcaaattcctcattgatgattacgatttttgtgtggcccatcaggatatgatgcaaacaattttgccattgagaggtgttctccgtgcccgattcccgacaaaagttaatggcggaattggtccggaccttaaggaagttttggccaaatttttgtccggcgtcaacattattgtcaaaccaaatttggccaaacccgaatggggcctttgcgaaccaattgtgggaagggtaaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 623 - DNA, 2472 bp, Artificial Sequence
  Description of Artificial Sequence: Synthetic polynucleotide
  modified_base (75)..(75): a, c, t, g, unknown or other
  modified_base (229)..(1494): a, c, t, g, unknown or other
  modified_base (1633)..(1633): a, c, t, g, unknown or other
  modified_base (1635)..(1635): a, c, t, g, unknown or other
  modified_base (1644)..(1653): a, c, t, g, unknown or other
  modified_base (1655)..(1656): a, c, t, g, unknown or other
  modified_base (1659)..(1659): a, c, t, g, unknown or other
  modified_base (1663)..(1663): a, c, t, g, unknown or other
  modified_base (1665)..(1666): a, c, t, g, unknown or other
  modified_base (1686)..(1686): a, c, t, g, unknown or other
  modified_base (1692)..(1692): a, c, t, g, unknown or other
  modified_base (1695)..(1695): a, c, t, g, unknown or other
  modified_base (1697)..(1697): a, c, t, g, unknown or other
  modified_base (1701)..(1701): a, c, t, g, unknown or other
  modified_base (1704)..(1707): a, c, t, g, unknown or other
  modified_base (1709)..(1710): a, c, t, g, unknown or other
  modified_base (1713)..(1716): a, c, t, g, unknown or other
  modified_base (1719)..(1720): a, c, t, g, unknown or other
  modified_base (1725)..(1727): a, c, t, g, unknown or other
  modified_base (1729)..(1729): a, c, t, g, unknown or other
  modified_base (1733)..(1733): a, c, t, g, unknown or other
  modified_base (1735)..(1736): a, c, t, g, unknown or other
  modified_base (1739)..(1739): a, c, t, g, unknown or other
  modified_base (1749)..(1752): a, c, t, g, unknown or other
  modified_base (1755)..(1755): a, c, t, g, unknown or other
  modified_base (1758)..(1758): a, c, t, g, unknown or other
  modified_base (1760)..(1760): a, c, t, g, unknown or other
  modified_base (1764)..(1764): a, c, t, g, unknown or other
  modified_base (1770)..(1771): a, c, t, g, unknown or other
  modified_base (1773)..(1777): a, c, t, g, unknown or other
  modified_base (1779)..(1781): a, c, t, g, unknown or other
  modified_base (1785)..(1785): a, c, t, g, unknown or other
  modified_base (1794)..(1795): a, c, t, g, unknown or other
  modified_base (1798)..(1798): a, c, t, g, unknown or other
  modified_base (1802)..(1803): a, c, t, g, unknown or other
  modified_base (1812)..(1812): a, c, t, g, unknown or other
  modified_base (1815)..(1815): a, c, t, g, unknown or other
  modified_base (1818)..(1819): a, c, t, g, unknown or other
  modified_base (1821)..(1821): a, c, t, g, unknown or other
  modified_base (1824)..(1829): a, c, t, g, unknown or other
  modified_base (1831)..(1834): a, c, t, g, unknown or other
  modified_base (1836)..(1837): a, c, t, g, unknown or other
  modified_base (1839)..(1839): a, c, t, g, unknown or other
  modified_base (1842)..(1845): a, c, t, g, unknown or other
  modified_base (1847)..(1847): a, c, t, g, unknown or other
  modified_base (1851)..(1851): a, c, t, g, unknown or other
  modified_base (1938)..(1938): a, c, t, g, unknown or other
  modified_base (2038)..(2043): a, c, t, g, unknown or other
  modified_base (2170)..(2472): a, c, t, g, unknown or other
atgaattacgtctactacatttacaacaacgtcaaatatttatacaattctatgaacccggccacattatccgtngcaatcgatgtgattgttgttgaacagccagacgggactttactttcaacgccttttcatgttcgcttcggcaaatatggtgttttcacttacgaaaacaagtgtgtggatattgaaatcaataacactgaaattgacttgaaaatgaaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgggagaaaaacgaaatacaaaagagcattgcgcctcaccagtgaccaactcaaattgcttaacctcaattatggatcgaatgatgcccgatttagcataaccacaaaattacaggggaccgcctggtgccattgcnanatttatttnnnnnnnnnnannganaaantnntcatttccgacattgatggnacaatnacnanaagngannnncnnggnnnngtnnttccnnnanttgngnnaanttgggcacannnnggngtngncganttgtanncnnnnntnnnaaanaatggatannaantggnntatttgtcntcncgnncnatnnnnnnannnnannanacnnnngnatancttcaaagtattacgcagggatcggaaaaacttccggatggtccagtccttctctcgcccacatccgtcctcatggcattcagaaangaagtgatcgaacgtaggccggaagaattcaaaattgcatgtttgaccgatttgaagtcccttttccccgtggaatcgccattcttcgctggttttggcnnnnnnttaaaggatgtaaaatcctatcaagctgttaacattccattggagcgaattttgatcatcgatccatcgggaatgttgcgccgggccgacaaaattggctacgtttctgactatgcgacaatggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 624 - DNA, 1080 bp, Artificial Sequence
  Description of Artificial Sequence: Synthetic polynucleotide
  modified_base (1)..(15): a, c, t, g, unknown or other
  modified_base (68)..(71): a, c, t, g, unknown or other
  modified_base (76)..(81): a, c, t, g, unknown or other
  modified_base (918)..(918): a, c, t, g, unknown or other
  modified_base (1015)..(1080): a, c, t, g, unknown or other
nnnnnnnnnnnnnnnttttcagtcaaagaatttttggacaaggccaaggacgatttcaagcagaaatnnnncaatnnnnnntagaacaattcatgtttggacgattttgaccggcttaaaaccctgggcactggctcattcggacgggtgatgctggtgaagcataaacaaacgggcacatattttgccatgaaaatattggacaagcaaaaagtggtcaaattgaagcaggttgagcacacgttgaatgagaaacgaatcctgcaggccatcgattttcccttcctcgtcaatatgcaatattcattcaaagacaattccaacctgtatatggtgctggaattcgtttcgggtggcgaaatgttctcgcatttgcgtcgaattggccgcttctctgagccccattcccgcttttatgcggcccaaattgtgctcgcctttgagtatttgcactcattggatctcatctacagggatttgaagcccgaaaatctgctcatcgacaacaatggctatttgaagatcaccgacttcggttttgccaaacgggtaaagggcaggacatggactttgtgtgggacgcccgaatatttggcaccggagatcatcctcagcaagggctataataaagccgttgattggtgggcacttggagtgctgatctatgaaatggccgccggctatccacctttctttgccgatcaacccatccaaatttatgagaaaattgtctccggaaaggtcaaattcccgtcacatttctccaatgaattgaaggatttgctgaagaatttattgcaagtggatttgaccaaaagatttggcaatttgaagaatggggtggccgacatcaaaaaccataaatggtttggttccgtcgattggattgccatttatcagcgaaaggtaaacaaatcnccatccgccaaaaatccaattgaatgccgactcctcgaggcattgtacccaaaaatcagtggccccgatgatactcgacattttgtggacaatgttnnnnnnnnnnnnnnnnnnnnnnnnnnnnnnnnnnnnnnnnnnnnnnnnnnnnnnnnnnnnnnnnnn

SEQ ID NO: 625 - DNA, 2430 bp, Artificial Sequence
  Description of Artificial Sequence: Synthetic polynucleotide
  modified_base (1)..(312): a, c, t, g, unknown or other
  modified_base (402)..(402): a, c, t, g, unknown or other
  modified_base (490)..(960): a, c, t, g, unknown or other
  modified_base (1128)..(1128): a, c, t, g, unknown or other
  modified_base (1162)..(1800): a, c, t, g, unknown or other
  modified_base (1957)..(2430): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttagtgttgcgcccgcatcgaacatcccaaatggaaatcgagtgcacattttgcccattgacgacaccgttgagggcattactcgnaatttgttcgaggtttatctgaaaccatattttctcgagacatatcgtccggtgcacaaaggggacacattcacggtcaatgcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagacacatggtgaagttgaacgccgtattgtctcgcagcttttgacactgatggatgggctcaaacaacgctcgaatgtgattgtgatcggcgcgactaatcgtccaaattcaattgacccggcacttcgtcgctttggacgtttcgatcgagaaattgatattcgnattcctgatgcaattggtcgtctggaaattcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaagttgaacgccgtattgtctcgcagcttttgacactgatggatgggctcaaacaacgctcgaatgtgattgtgatcggcgcgactaatcgtccaaattcaattgacccggcacttcgtcgctttggacgtttcgatcgagaaattgatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 626 - DNA, 3426 bp, Artificial Sequence
  Description of Artificial Sequence: Synthetic polynucleotide
  modified_base (1)..(363): a, c, t, g, unknown or other
  modified_base (586)..(1068): a, c, t, g, unknown or other
  modified_base (1195)..(1434): a, c, t, g, unknown or other
  modified_base (1439)..(1440): a, c, t, g, unknown or other
  modified_base (1464)..(1464): a, c, t, g, unknown or other
  modified_base (1467)..(1467): a, c, t, g, unknown or other
  modified_base (1476)..(1476): a, c, t, g, unknown or other
  modified_base (1488)..(1488): a, c, t, g, unknown or other
  modified_base (1491)..(1491): a, c, t, g, unknown or other
  modified_base (1500)..(1500): a, c, t, g, unknown or other
  modified_base (1518)..(1518): a, c, t, g, unknown or other
  modified_base (1530)..(1530): a, c, t, g, unknown or other
  modified_base (1533)..(1533): a, c, t, g, unknown or other
  modified_base (1545)..(1545): a, c, t, g, unknown or other
  modified_base (1548)..(1548): a, c, t, g, unknown or other
  modified_base (1563)..(1563): a, c, t, g, unknown or other
  modified_base (1588)..(1588): a, c, t, g, unknown or other
  modified_base (1624)..(2487): a, c, t, g, unknown or other
  modified_base (2683)..(2994): a, c, t, g, unknown or other
  modified_base (3099)..(3099): a, c, t, g, unknown or other
  modified_base (3214)..(3426): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattgaactttgatctcacgaccggtttcctaaatttacttgtcaacttcatctccctgatgattcttccctcacggattgaagaccgaaaagccgtccttggcctattcaacgctgcctatgatttaatgcacaccggcagtgaggcatcatttcctcggcttggccaaatgattgctgactatgagcaaccattgaggaaattggccgaggatttgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcaacccggattgttgggcccaaaaattttgttcgtttggatgggcctttccatggccagggacgaggtcctttggctgctcagacattttgaccattggcctcaattgttgcaaaattcatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattnncgcgccgtttgccttgactggttncgnttccaagcnttgaccagcgtngcncgttccacnttcaatttgaaggcccangccaattttgcngtngcaatgaacacntcnattttccacatgaancaaattgacgatttggaggaaatgntcaaggagaccagcgacctcaatatttattggttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttttcctctacaatagaactccgctcccttgcccaattgattggcccctacggcataaaattgatggaggaaaagttggtttggcatattgccagccaaattacggaattattcaaaattgtccgtgaaaacaaggaggcattgcattcggcacgggttaactatgataaaccgagcaaattgagagaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagcattacaacatttcctgccttctcatcgtattcattgccattggattgccccggcttgccacactgccccaatccttttatagggcttcaatggcttgnaccaaaaacaattcacacacaatcccgttggctgtgaacacattggccggtgcactgttcttcttgcatcaacgtggagacactgctgacagaatgcgtgaattcttggcggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 627 - DNA, 1233 bp, Artificial Sequence
  Description of Artificial Sequence: Synthetic polynucleotide
  modified_base (1)..(174): a, c, t, g, unknown or other
  modified_base (179)..(179): a, c, t, g, unknown or other
  modified_base (234)..(234): a, c, t, g, unknown or other
  modified_base (243)..(243): a, c, t, g, unknown or other
  modified_base (331)..(336): a, c, t, g, unknown or other
  modified_base (724)..(798): a, c, t, g, unknown or other
  modified_base (1228)..(1233): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcanggacaacgaaatgggaccattctatgagcaagcctgcaaacaagtgaacatgaanattgatgcngcattgctggaccaattcaaagcgaaaaacaaagctcgattggacgaaattgacaagcaaattgaggatgcggagaaaaatttgggtnnnnnngaagttcgtcaggcatggctggccaaatcagaatatttatgcaaaattggggacaaaacaaatgcagttgaggcattcggaaaaactttcgacaaaactgtgggcgttggctatcgcatcgatttggtgttcaatttaatccgaattggccttttcttcatggatcacgaattgattaccacaaatattgaaaaggcaaaggaactgatggaaaagggaggcgattgggaccgcaaaaaccgactccgttcgtatgaaggactttacaaaatggccattcgcgacatgaaaggagcggctgaacttttcctggaagcagtgccaacattcggagcatacgaattgatgaattacgaggatttgattttttacaccgtcgtcacttccnnnnnnnnnnnnnnnnnnnnnnnnnnnnnnnnnnnnnnnnnnnnnnnnnnnnnnnnnnnnnnnnnnnnnnnnnnnggtgaaaataacgcgaatctcccgttggccaaaaatctgttgaacacattcttcgcctccgaatatgacaaatttttggttgcattggccaaattggagagggatgttctcctgcatgatcgttatttgaagccacattgccaattttacacacgggcaatgcgcgtcaaagcctatcaacaattcttggctccttataaatcggtcaaattggatacgatggcagcaagttttggtgttacgaaggattatttggagcaacaattgttcaccttcatttcctctggactgctcagttgccgaattgatggttgccagggagtggtggaaatggcccaaactgaccacaaaaatcaactctacaagaaattgctccatgatggcgacattctcctcaatcgagtccaaaaattgtcgcgagtgatcaatnnnnnn

SEQ ID NO: 628 - DNA, 2955 bp, Artificial Sequence
  Description of Artificial Sequence: Synthetic polynucleotide
  modified_base (1)..(906): a, c, t, g, unknown or other
  modified_base (982)..(984): a, c, t, g, unknown or other
  modified_base (1045)..(1047): a, c, t, g, unknown or other
  modified_base (1089)..(1089): a, c, t, g, unknown or other
  modified_base (1201)..(1266): a, c, t, g, unknown or other
  modified_base (1387)..(1485): a, c, t, g, unknown or other
  modified_base (1531)..(1536): a, c, t, g, unknown or other
  modified_base (1809)..(1809): a, c, t, g, unknown or other
  modified_base (1968)..(1968): a, c, t, g, unknown or other
  modified_base (2103)..(2103): a, c, t, g, unknown or other
  modified_base (2136)..(2136): a, c, t, g, unknown or other
  modified_base (2247)..(2247): a, c, t, g, unknown or other
  modified_base (2425)..(2586): a, c, t, g, unknown or other
  modified_base (2734)..(2955): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatgccgactaccttttggcttacatattcaaccattccgcgatatgcgaggtttgaaaattatccaaacgnnnaatatcacacgctgtcgttattgccgaacatatatcaatccatttgtgttcattatggatnnncagcattggaaatgcaatttatgctatcgggccaatgattancccgaagagttttcttgggatccgcaaacgagaacattcggtgatccatcaagaagacctgaactccaggaaaccaccattgaatatattgcaccggctgaatacatggttnnnnnnnnnnnnnnnnnnnnnnnnnnnnnnnnnnnnnnnnnnnnnnnnnnnnnnnnnnnnnnnnnntatttgcatactttctccgaacaattgctaatggacatggaaaaattgccgggcaatgaacgagcattgattggcttcctcggtttcgactcggcattacattttttccattttgataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtattctcaatttcatacaacggataccgagcatatttgagcgannnnnnggaagttcccaatcaaattgtcttggatctgctttgagtgttgtcaaagaattaattcaagaaattggtggacgaatcacagttttgacggcctcaatgccgaatattggcgcaggtgcattgaaaatcagagattcatccaaatccgcaaaattggtgttcactcctcaaatggattattatcggacattggcattagagtgcacgggtaaacaaattgcgatcgatttattcgccattggttgcaaaaatatggatcttttgactttacgngatatggccagattcagtggtggctcaatttatcattttccaacttatcattttgtccgggaccaagttgaagtcaaaagactgcaaatggttttgcataggtatttgacgaggaaactcggattggaagcagtgctcagaatacgatgctcaagagancttgccttgcacactttttatgggaatttttttgtccgttccaccgacctccttgctctgcccaatgtcaatccggatgccgctttgggtgttcaaataaagcacgaagaaccgctcaccagccatgtttgtttncaagccgcccttctctacacctcaacaaaagtngatcgtcgaattcgtgtccataccctaagtttgcctgtgctcaacaattcaacacatctttattccgcaatggacattaacacatccatttccctcctctccaaaatgcantccgaacgtgcaatgttgggctcagatttgacggattgtcgagaagcgttgatcaattcagtggtggatggattggccggatatcaacgaattttgggtcaaacgagcacccaattgatgccaccggacgggggactccaatacatgccaatttatgtgcttggattactcaaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaattcagttatgaacatgtgtcaagggagggaatttatttgctcgacactggcacttatgtttatttgtatgtttgttcggcagcacatccccaaacaatttttggaatttttggcgtaaattcctttggcaaattggacgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 629 - DNA, 465 bp, Artificial Sequence
  Description of Artificial Sequence: Synthetic polynucleotide
  modified_base (207)..(207): a, c, t, g, unknown or other
  modified_base (252)..(252): a, c, t, g, unknown or other
  modified_base (460)..(465): a, c, t, g, unknown or other
atggtttttcatcctaaatcaaaggacaaagcaagagaaatcagttcatatcgagatatgcgatttgagggatctgttacagaacaggaaaggagattggctcagtcaactacgctttatattgggaacctttcatattttacaacagaagaacaagtttgggaattgtttcaacgagctggcgacattcgtcgggtcattatggtnctagatcgatttcaaaaaactccttgcggattttgttttgtcaantattacacccgacaagatgcggaaaatgcattacgctatattaatggtactagattggatgacagagttattcgttgcgattgggacgcaggattcaaagaaggaagacaatatgggagggggaaacacggaggacaagttcgggatgaatatcgtcaaaactttgacgcaggtcgtggaggctggaataaaacaattcaaaaacggnnnnnn

SEQ ID NO: 630 - DNA, 4086 bp, Artificial Sequence
  Description of Artificial Sequence: Synthetic polynucleotide
  modified_base (1)..(990): a, c, t, g, unknown or other
  modified_base (1189)..(1383): a, c, t, g, unknown or other
  modified_base (1530)..(1530): a, c, t, g, unknown or other
  modified_base (1594)..(1806): a, c, t, g, unknown or other
  modified_base (2076)..(2076): a, c, t, g, unknown or other
  modified_base (2161)..(2271): a, c, t, g, unknown or other
  modified_base (2380)..(2580): a, c, t, g, unknown or other
  modified_base (2755)..(2757): a, c, t, g, unknown or other
  modified_base (2818)..(3057): a, c, t, g, unknown or other
  modified_base (3160)..(4086): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcaggaattggtgccgcctaccaggatcgaccatgcattgatccactggattcgtactgcccaaaaacggcgccaaattattttcaacgttgcaaagcattcgaaatgttcgttgaatggaatggaaaattgcctaaagaagaacaaatccatttggagccaacattgaagggaaaaacaaagggaaaagggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgaaaaatatggacaaagttttatggaatggatgcgatcaaatcgactaaaattggatgcatttttgccaccagagctgaggccacattatccaaattatggcgaaataatgaccggtggatgcaaaggattcgggaaaaataanatgaattggccagaggatttgattgttggaggaataaaaaggaatcgaatggatttgttgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctccacttcaatccaggatatgcttgaacaattcagtgaattccaatttctgacaattttcattggctacgttttgatgattatttatgctggatggtcacaattacaatgggatggttggtggttttcgtcaaaatcgagttgtatgcttgcggtcattggcgtccttgtgattactttggcttcagtagccggtttgggtttatcaacggcaatgggcattcatttcaatgcggccaccactcaagtaaaataattattgcctaantggatgggcatcgatgatatgttccttcttttgcacaattataatgatgttttggaagcagtgaaagagaaggagattgcagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcaattcttttaaccgcaaatcttgttggcattttcttcatttaccccgcatttattgcattggatttgaagcggaggaaagctgggcgaagggatttagcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaacaattttgctcctttggtcggcaatgctactctttggttgcgttggtctttatcgatcaaaaattggacttgaattggccgatgtcttgcctgaacatacggcaccggccgcatttttgaaggccagagagaaatatttcagtttttatccaatgttcattgtgccaaaannngaagggatggattatccaaatcaacaattaaaattggaacaattgcgaatggatattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgatttattcttccaatgatttaattaatccggatggtttttacaattatttgactgcatggttccatcttgacaatatgatgtaatatttaaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 631 - DNA, 1314 bp, Artificial Sequence
  Description of Artificial Sequence: Synthetic polynucleotide
  modified_base (184)..(786): a, c, t, g, unknown or other
  modified_base (901)..(1314): a, c, t, g, unknown or other
atgctcgttgtcgtcatccacccggaacaatggaatggcggctcggaccggtgcacgattggattgttacggcatttcgtccaagccggccatcaggtcgtttggttgaccacaatgattgatgattattgggcgggcgaggatttccagggtgttggtcagtttgaaaaatacctcaaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttctcccaaattttccagtttgtgccggacccaagtgatgagcgcaaattccaactgtatcgacaatgcgattcggcaatctacacaccaccaaatgagcattttggcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 632 - DNA, 1710 bp, Artificial Sequence
  Description of Artificial Sequence: Synthetic polynucleotide
  modified_base (1)..(579): a, c, t, g, unknown or other
  modified_base (738)..(738): a, c, t, g, unknown or other
  modified_base (826)..(912): a, c, t, g, unknown or other
  modified_base (1066)..(1071): a, c, t, g, unknown or other
  modified_base (1111)..(1116): a, c, t, g, unknown or other
  modified_base (1210)..(1296): a, c, t, g, unknown or other
  modified_base (1359)..(1359): a, c, t, g, unknown or other
  modified_base (1435)..(1512): a, c, t, g, unknown or other
  modified_base (1687)..(1710): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgttcattcactggttttgacaatcgatggcgtcgtgtacagttgcggtgtaaatgagaaaggaacagtccctgtggaaggacttgaggccgaagagaccatcgacaaattcagtgaaattgttttctcagatgaaatacaaaaaactgggcaaacngttcaaatcacagccggtgccagtttttctgctgctttgaccgagaaaggttcagtcatcgcatggggaaatctcagggtaattaacnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcagccggtgaaaaccatttggccatgctttccaatgaaggagaattgcttacttttggagaaggttcaatgggtcaacttggtcgcaccacacgcactcaacacattcgttccaaatttatggtcgatgaatccggcaattcgcttattnnnnnnctacgtgtacttgaaaagcaccaatttatccgttttgttnnnnnngatgtttgggcccagggattctggacaattggacgagctcaagatggacggctgtttgtgtgtggcctcaacaattttggacaacttggtgttnnnnnnnnnnnnnnnnnnnnnnnnnnnnnnnnnnnnnnnnnnnnnnnnnnnnnnnnnnnnnnnnnnnnnnnnnnnnnnnnnnnnnnngcagagaagaaatggaaacatatttcaggtgttcaacatatcgtatgttgcactgaggaagtngaactctatgggattggcaagaatacggataatgcacttggattgggcacatgggaagggaatcaagatgataagnnnnnnnnnnnnnnnnnnnnnnnnnnnnnnnnnnnnnnnnnnnnnnnnnnnnnnnnnnnnnnnnnnnnnnnnnnnnnnatttccaaaaaatattcaggcaaagtttatggatttggttgcgacacagttggtcaacttggtcttggcattaaggatgatgacgacaaaattgtgcccgtgccacgtcagataacttcggcacatttggatggatttcgtgttatcagcgtttcgatggccgacaaccattcannnnnnnnnnnnnnnnnnnnnnnn

SEQ ID NO: 633 - DNA, 615 bp, Artificial Sequence
  Description of Artificial Sequence: Synthetic polynucleotide
  modified_base (1)..(120): a, c, t, g, unknown or other
  modified_base (262)..(615): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggttcatcgtgttgatgataaactctttgttggtctttgcggattcagttgtgacactgcgacaattttggacaaaatcaagacacataaggcactctatgagcttaaagaagatcgtccaatgaaaccaaaagtaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 634 - DNA, 3132 bp, Artificial Sequence
  Description of Artificial Sequence: Synthetic polynucleotide
  modified_base (1)..(441): a, c, t, g, unknown or other
  modified_base (670)..(1692): a, c, t, g, unknown or other
  modified_base (1777)..(1779): a, c, t, g, unknown or other
  modified_base (1912)..(2487): a, c, t, g, unknown or other
  modified_base (2722)..(3132): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctgattcaaagtgtcaattcactcaaacaattgtacacgcttagcatggatgtccataaaaggtatcgcacggaagcccattcaaacattgttcctcgattcaatgaacgtttcatcctttcgttggccaattgcaaaacttgtttggccatggacgatcgactcaacgttttgccaatttcctcaacaatttttaatattgctccaattttgccaagtcaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagattttggcagtaattcaactttgtttggaaggtgcaatttcgcaaaaatctgtccagaatgcacaggaaaagggaaaaaggnnngccggtgacctcattccatggactcttagccaatattatttggttggttattttaatttgaaatttttttcaattttagttcgtattgcagtccatcccgactttcaaggaatgggctacggatcgatggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgccactatgcgaagaatatggccgatcacaatttgatcactgatttgctgcccacattggccacactttacttcaatgaacgaatcgctgcggcggtcacattggatttgggccaagcagctgtgctccttggtgttggcctgcaacgaaaattggtggaccaaactgccacagaattgggattaccttccaatcaggcatatgctttgttgaataaggccatacgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 635 - DNA, 14262 bp, Artificial Sequence
  Description of Artificial Sequence: Synthetic polynucleotide
  modified_base (1)..(264): a, c, t, g, unknown or other
  modified_base (333)..(334): a, c, t, g, unknown or other
  modified_base (336)..(336): a, c, t, g, unknown or other
  modified_base (341)..(341): a, c, t, g, unknown or other
  modified_base (344)..(344): a, c, t, g, unknown or other
  modified_base (359)..(359): a, c, t, g, unknown or other
  modified_base (378)..(378): a, c, t, g, unknown or other
  modified_base (385)..(385): a, c, t, g, unknown or other
  modified_base (388)..(392): a, c, t, g, unknown or other
  modified_base (394)..(394): a, c, t, g, unknown or other
  modified_base (403)..(404): a, c, t, g, unknown or other
  modified_base (407)..(409): a, c, t, g, unknown or other
  modified_base (423)..(428): a, c, t, g, unknown or other
  modified_base (462)..(463): a, c, t, g, unknown or other
  modified_base (466)..(466): a, c, t, g, unknown or other
  modified_base (473)..(473): a, c, t, g, unknown or other
  modified_base (487)..(487): a, c, t, g, unknown or other
  modified_base (502)..(502): a, c, t, g, unknown or other
  modified_base (507)..(507): a, c, t, g, unknown or other
  modified_base (521)..(522): a, c, t, g, unknown or other
  modified_base (525)..(525): a, c, t, g, unknown or other
  modified_base (527)..(527): a, c, t, g, unknown or other
  modified_base (532)..(532): a, c, t, g, unknown or other
  modified_base (535)..(535): a, c, t, g, unknown or other
  modified_base (538)..(538): a, c, t, g, unknown or other
  modified_base (547)..(547): a, c, t, g, unknown or other
  modified_base (552)..(552): a, c, t, g, unknown or other
  modified_base (556)..(556): a, c, t, g, unknown or other
  modified_base (571)..(571): a, c, t, g, unknown or other
  modified_base (574)..(574): a, c, t, g, unknown or other
  modified_base (592)..(592): a, c, t, g, unknown or other
  modified_base (603)..(603): a, c, t, g, unknown or other
  modified_base (616)..(616): a, c, t, g, unknown or other
  modified_base (636)..(636): a, c, t, g, unknown or other
  modified_base (642)..(642): a, c, t, g, unknown or other
  modified_base (650)..(650): a, c, t, g, unknown or other
  modified_base (654)..(654): a, c, t, g, unknown or other
  modified_base (658)..(658): a, c, t, g, unknown or other
  modified_base (660)..(660): a, c, t, g, unknown or other
  modified_base (664)..(664): a, c, t, g, unknown or other
  modified_base (669)..(669): a, c, t, g, unknown or other
  modified_base (671)..(671): a, c, t, g, unknown or other
  modified_base (674)..(674): a, c, t, g, unknown or other
  modified_base (679)..(679): a, c, t, g, unknown or other
  modified_base (685)..(685): a, c, t, g, unknown or other
  modified_base (693)..(693): a, c, t, g, unknown or other
  modified_base (697)..(697): a, c, t, g, unknown or other
  modified_base (699)..(699): a, c, t, g, unknown or other
  modified_base (702)..(702): a, c, t, g, unknown or other
  modified_base (713)..(713): a, c, t, g, unknown or other
  modified_base (722)..(722): a, c, t, g, unknown or other
  modified_base (736)..(736): a, c, t, g, unknown or other
  modified_base (738)..(738): a, c, t, g, unknown or other
  modified_base (744)..(744): a, c, t, g, unknown or other
  modified_base (751)..(753): a, c, t, g, unknown or other
  modified_base (759)..(759): a, c, t, g, unknown or other
  modified_base (763)..(763): a, c, t, g, unknown or other
  modified_base (765)..(766): a, c, t, g, unknown or other
  modified_base (772)..(776): a, c, t, g, unknown or other
  modified_base (778)..(783): a, c, t, g, unknown or other
  modified_base (786)..(786): a, c, t, g, unknown or other
  modified_base (789)..(789): a, c, t, g, unknown or other
  modified_base (792)..(798): a, c, t, g, unknown or other
  modified_base (800)..(801): a, c, t, g, unknown or other
  modified_base (853)..(1596): a, c, t, g, unknown or other
  modified_base (1603)..(1604): a, c, t, g, unknown or other
  modified_base (1606)..(1606): a, c, t, g, unknown or other
  modified_base (1608)..(1608): a, c, t, g, unknown or other
  modified_base (1611)..(1618): a, c, t, g, unknown or other
  modified_base (1620)..(1620): a, c, t, g, unknown or other
  modified_base (1629)..(1629): a, c, t, g, unknown or other
  modified_base (1640)..(1641): a, c, t, g, unknown or other
  modified_base (1644)..(1644): a, c, t, g, unknown or other
  modified_base (1656)..(1657): a, c, t, g, unknown or other
  modified_base (1659)..(1659): a, c, t, g, unknown or other
  modified_base (1661)..(1663): a, c, t, g, unknown or other
  modified_base (1666)..(1671): a, c, t, g, unknown or other
  modified_base (1673)..(1676): a, c, t, g, unknown or other
  modified_base (1678)..(1678): a, c, t, g, unknown or other
  modified_base (1682)..(1684): a, c, t, g, unknown or other
  modified_base (1686)..(1686): a, c, t, g, unknown or other
  modified_base (1689)..(1690): a, c, t, g, unknown or other
  modified_base (1692)..(1693): a, c, t, g, unknown or other
  modified_base (1696)..(1696): a, c, t, g, unknown or other
  modified_base (1698)..(1698): a, c, t, g, unknown or other
  modified_base (1701)..(1702): a, c, t, g, unknown or other
  modified_base (1704)..(1704): a, c, t, g, unknown or other
  modified_base (1707)..(1707): a, c, t, g, unknown or other
  modified_base (1710)..(1710): a, c, t, g, unknown or other
  modified_base (1712)..(1716): a, c, t, g, unknown or other
  modified_base (1720)..(1720): a, c, t, g, unknown or other
  modified_base (1722)..(1722): a, c, t, g, unknown or other
  modified_base (1726)..(1726): a, c, t, g, unknown or other
  modified_base (1731)..(1735): a, c, t, g, unknown or other
  modified_base (1737)..(1737): a, c, t, g, unknown or other
  modified_base (1740)..(1740): a, c, t, g, unknown or other
  modified_base (1742)..(1743): a, c, t, g, unknown or other
  modified_base (1752)..(1755): a, c, t, g, unknown or other
  modified_base (1758)..(1758): a, c, t, g, unknown or other
  modified_base (1761)..(1761): a, c, t, g, unknown or other
  modified_base (1763)..(1765): a, c, t, g, unknown or other
  modified_base (2110)..(2115): a, c, t, g, unknown or other
  modified_base (2326)..(2490): a, c, t, g, unknown or other
  modified_base (2752)..(2982): a, c, t, g, unknown or other
  modified_base (3173)..(3176): a, c, t, g, unknown or other
  modified_base (3184)..(3184): a, c, t, g, unknown or other
  modified_base (3199)..(3199): a, c, t, g, unknown or other
  modified_base (3221)..(3222): a, c, t, g, unknown or other
  modified_base (3246)..(3246): a, c, t, g, unknown or other
  modified_base (3252)..(3252): a, c, t, g, unknown or other
  modified_base (3255)..(3255): a, c, t, g, unknown or other
  modified_base (3264)..(3265): a, c, t, g, unknown or other
  modified_base (3273)..(3273): a, c, t, g, unknown or other
  modified_base (3276)..(3279): a, c, t, g, unknown or other
  modified_base (3282)..(3282): a, c, t, g, unknown or other
  modified_base (3286)..(3287): a, c, t, g, unknown or other
  modified_base (3294)..(3294): a, c, t, g, unknown or other
  modified_base (3296)..(3296): a, c, t, g, unknown or other
  modified_base (3304)..(3306): a, c, t, g, unknown or other
  modified_base (3310)..(3310): a, c, t, g, unknown or other
  modified_base (3314)..(3315): a, c, t, g, unknown or other
  modified_base (3327)..(3327): a, c, t, g, unknown or other
  modified_base (3333)..(3333): a, c, t, g, unknown or other
  modified_base (3336)..(3337): a, c, t, g, unknown or other
  modified_base (3351)..(3351): a, c, t, g, unknown or other
  modified_base (3356)..(3357): a, c, t, g, unknown or other
  modified_base (3369)..(3369): a, c, t, g, unknown or other
  modified_base (3421)..(3421): a, c, t, g, unknown or other
  modified_base (3424)..(3424): a, c, t, g, unknown or other
  modified_base (3427)..(3427): a, c, t, g, unknown or other
  modified_base (3430)..(3430): a, c, t, g, unknown or other
  modified_base (3432)..(3432): a, c, t, g, unknown or other
  modified_base (3434)..(3434): a, c, t, g, unknown or other
  modified_base (3438)..(3438): a, c, t, g, unknown or other
  modified_base (3445)..(3445): a, c, t, g, unknown or other
  modified_base (3448)..(3448): a, c, t, g, unknown or other
  modified_base (3468)..(3468): a, c, t, g, unknown or other
  modified_base (3480)..(3480): a, c, t, g, unknown or other
  modified_base (3492)..(3492): a, c, t, g, unknown or other
  modified_base (3501)..(3501): a, c, t, g, unknown or other
  modified_base (3504)..(3504): a, c, t, g, unknown or other
  modified_base (3541)..(3541): a, c, t, g, unknown or other
  modified_base (3550)..(3550): a, c, t, g, unknown or other
  modified_base (3558)..(3558): a, c, t, g, unknown or other
  modified_base (3611)..(3611): a, c, t, g, unknown or other
  modified_base (3613)..(3613): a, c, t, g, unknown or other
  modified_base (3624)..(3624): a, c, t, g, unknown or other
  modified_base (3655)..(3655): a, c, t, g, unknown or other
  modified_base (3660)..(3660): a, c, t, g, unknown or other
  modified_base (3671)..(3671): a, c, t, g, unknown or other
  modified_base (3674)..(3674): a, c, t, g, unknown or other
  modified_base (3701)..(3701): a, c, t, g, unknown or other
  modified_base (3729)..(3729): a, c, t, g, unknown or other
  modified_base (3733)..(3733): a, c, t, g, unknown or other
  modified_base (3737)..(3737): a, c, t, g, unknown or other
  modified_base (3739)..(3739): a, c, t, g, unknown or other
  modified_base (3750)..(3750): a, c, t, g, unknown or other
  modified_base (3774)..(3774): a, c, t, g, unknown or other
  modified_base (3783)..(3787): a, c, t, g, unknown or other
  modified_base (3796)..(3796): a, c, t, g, unknown or other
  modified_base (3798)..(3798): a, c, t, g, unknown or other
  modified_base (3812)..(3812): a, c, t, g, unknown or other
  modified_base (3816)..(3817): a, c, t, g, unknown or other
  modified_base (3836)..(3836): a, c, t, g, unknown or other
  modified_base (3839)..(3839): a, c, t, g, unknown or other
  modified_base (3841)..(3841): a, c, t, g, unknown or other
  modified_base (3845)..(3845): a, c, t, g, unknown or other
  modified_base (3865)..(3865): a, c, t, g, unknown or other
  modified_base (3867)..(3867): a, c, t, g, unknown or other
  modified_base (3880)..(3880): a, c, t, g, unknown or other
  modified_base (3897)..(3897): a, c, t, g, unknown or other
  modified_base (3899)..(3899): a, c, t, g, unknown or other
  modified_base (3914)..(3914): a, c, t, g, unknown or other
  modified_base (3917)..(3918): a, c, t, g, unknown or other
  modified_base (3924)..(3925): a, c, t, g, unknown or other
  modified_base (3927)..(3927): a, c, t, g, unknown or other
  modified_base (3929)..(3929): a, c, t, g, unknown or other
  modified_base (3931)..(3932): a, c, t, g, unknown or other
  modified_base (3940)..(3940): a, c, t, g, unknown or other
  modified_base (3942)..(3942): a, c, t, g, unknown or other
  modified_base (3962)..(3963): a, c, t, g, unknown or other
  modified_base (3970)..(3970): a, c, t, g, unknown or other
  modified_base (3985)..(3985): a, c, t, g, unknown or other
  modified_base (3993)..(3993): a, c, t, g, unknown or other
  modified_base (4026)..(4026): a, c, t, g, unknown or other
  modified_base (4034)..(4035): a, c, t, g, unknown or other
  modified_base (4037)..(4037): a, c, t, g, unknown or other
  modified_base (4048)..(4050): a, c, t, g, unknown or other
  modified_base (4053)..(4053): a, c, t, g, unknown or other
  modified_base (4055)..(4055): a, c, t, g, unknown or other
  modified_base (4057)..(4060): a, c, t, g, unknown or other
  modified_base (4063)..(4070): a, c, t, g, unknown or other
  modified_base (4072)..(4074): a, c, t, g, unknown or other
  modified_base (4078)..(4082): a, c, t, g, unknown or other
  modified_base (4084)..(4084): a, c, t, g, unknown or other
  modified_base (4086)..(4086): a, c, t, g, unknown or other
  modified_base (4093)..(4095): a, c, t, g, unknown or other
  modified_base (4098)..(4101): a, c, t, g, unknown or other
  modified_base (4106)..(4110): a, c, t, g, unknown or other
  modified_base (4112)..(4112): a, c, t, g, unknown or other
  modified_base (4114)..(4114): a, c, t, g, unknown or other
  modified_base (4123)..(4123): a, c, t, g, unknown or other
  modified_base (4125)..(4135): a, c, t, g, unknown or other
  modified_base (4137)..(4137): a, c, t, g, unknown or other
  modified_base (4146)..(4147): a, c, t, g, unknown or other
  modified_base (4152)..(4153): a, c, t, g, unknown or other
  modified_base (4160)..(4160): a, c, t, g, unknown or other
  modified_base (4168)..(4170): a, c, t, g, unknown or other
  modified_base (4176)..(4176): a, c, t, g, unknown or other
  modified_base (4197)..(4197): a, c, t, g, unknown or other
  modified_base (4264)..(4623): a, c, t, g, unknown or other
  modified_base (4716)..(4716): a, c, t, g, unknown or other
  modified_base (4797)..(4797): a, c, t, g, unknown or other
  modified_base (4803)..(4803): a, c, t, g, unknown or other
  modified_base (4824)..(4824): a, c, t, g, unknown or other
  modified_base (4827)..(4827): a, c, t, g, unknown or other
  modified_base (4830)..(4830): a, c, t, g, unknown or other
  modified_base (4867)..(4867): a, c, t, g, unknown or other
  modified_base (4875)..(4875): a, c, t, g, unknown or other
  modified_base (4878)..(4878): a, c, t, g, unknown or other
  modified_base (5281)..(5448): a, c, t, g, unknown or other
  modified_base (5746)..(5823): a, c, t, g, unknown or other
  modified_base (5878)..(5880): a, c, t, g, unknown or other
  modified_base (5962)..(5964): a, c, t, g, unknown or other
  modified_base (6331)..(6450): a, c, t, g, unknown or other
  modified_base (6742)..(6744): a, c, t, g, unknown or other
  modified_base (6817)..(6817): a, c, t, g, unknown or other
  modified_base (6819)..(6820): a, c, t, g, unknown or other
  modified_base (6824)..(6825): a, c, t, g, unknown or other
  modified_base (7051)..(7290): a, c, t, g, unknown or other
  modified_base (7462)..(7692): a, c, t, g, unknown or other
  modified_base (7795)..(7795): a, c, t, g, unknown or other
  modified_base (7797)..(7797): a, c, t, g, unknown or other
  modified_base (7800)..(7801): a, c, t, g, unknown or other
  modified_base (7809)..(7810): a, c, t, g, unknown or other
  modified_base (7813)..(7813): a, c, t, g, unknown or other
  modified_base (7815)..(7815): a, c, t, g, unknown or other
  modified_base (7818)..(7818): a, c, t, g, unknown or other
  modified_base (7823)..(7824): a, c, t, g, unknown or other
  modified_base (7827)..(7829): a, c, t, g, unknown or other
  modified_base (7832)..(7834): a, c, t, g, unknown or other
  modified_base (7836)..(7836): a, c, t, g, unknown or other
  modified_base (7840)..(7843): a, c, t, g, unknown or other
  modified_base (7845)..(7845): a, c, t, g, unknown or other
  modified_base (7849)..(7849): a, c, t, g, unknown or other
  modified_base (7851)..(7855): a, c, t, g, unknown or other
  modified_base (7857)..(7858): a, c, t, g, unknown or other
  modified_base (7860)..(7865): a, c, t, g, unknown or other
  modified_base (7867)..(7867): a, c, t, g, unknown or other
  modified_base (7869)..(7873): a, c, t, g, unknown or other
  modified_base (7875)..(7876): a, c, t, g, unknown or other
  modified_base (7878)..(7878): a, c, t, g, unknown or other
  modified_base (7881)..(7882): a, c, t, g, unknown or other
  modified_base (7888)..(7890): a, c, t, g, unknown or other
  modified_base (7892)..(7895): a, c, t, g, unknown or other
  modified_base (7897)..(7897): a, c, t, g, unknown or other
  modified_base (7899)..(7899): a, c, t, g, unknown or other
  modified_base (7902)..(7903): a, c, t, g, unknown or other
  modified_base (7908)..(7908): a, c, t, g, unknown or other
  modified_base (7910)..(7911): a, c, t, g, unknown or other
  modified_base (7914)..(7914): a, c, t, g, unknown or other
  modified_base (7918)..(7920): a, c, t, g, unknown or other
  modified_base (7923)..(7925): a, c, t, g, unknown or other
  modified_base (7927)..(7931): a, c, t, g, unknown or other
  modified_base (7938)..(7938): a, c, t, g, unknown or other
  modified_base (7940)..(7941): a, c, t, g, unknown or other
  modified_base (7943)..(7943): a, c, t, g, unknown or other
  modified_base (7947)..(7947): a, c, t, g, unknown or other
  modified_base (7953)..(7953): a, c, t, g, unknown or other
  modified_base (7957)..(7957): a, c, t, g, unknown or other
  modified_base (7960)..(7962): a, c, t, g, unknown or other
  modified_base (7965)..(7967): a, c, t, g, unknown or other
  modified_base (7969)..(7972): a, c, t, g, unknown or other
  modified_base (7974)..(7974): a, c, t, g, unknown or other
  modified_base (7977)..(7977): a, c, t, g, unknown or other
  modified_base (7979)..(7980): a, c, t, g, unknown or other
  modified_base (8169)..(8169): a, c, t, g, unknown or other
  modified_base (8341)..(8343): a, c, t, g, unknown or other
  modified_base (8419)..(8419): a, c, t, g, unknown or other
  modified_base (8421)..(8422): a, c, t, g, unknown or other
  modified_base (8425)..(8425): a, c, t, g, unknown or other
  modified_base (8427)..(8431): a, c, t, g, unknown or other
  modified_base (8433)..(8433): a, c, t, g, unknown or other
  modified_base (8443)..(8448): a, c, t, g, unknown or other
  modified_base (8457)..(8457): a, c, t, g, unknown or other
  modified_base (8461)..(8463): a, c, t, g, unknown or other
  modified_base (8469)..(8469): a, c, t, g, unknown or other
  modified_base (8474)..(8475): a, c, t, g, unknown or other
  modified_base (8477)..(8481): a, c, t, g, unknown or other
  modified_base (8483)..(8483): a, c, t, g, unknown or other
  modified_base (8487)..(8490): a, c, t, g, unknown or other
  modified_base (8492)..(8493): a, c, t, g, unknown or other
  modified_base (8497)..(8497): a, c, t, g, unknown or other
  modified_base (8508)..(8508): a, c, t, g, unknown or other
  modified_base (8529)..(8529): a, c, t, g, unknown or other
  modified_base (8531)..(8534): a, c, t, g, unknown or other
  modified_base (8545)..(8545): a, c, t, g, unknown or other
  modified_base (8547)..(8547): a, c, t, g, unknown or other
  modified_base (8552)..(8552): a, c, t, g, unknown or other
  modified_base (8555)..(8555): a, c, t, g, unknown or other
  modified_base (8571)..(8571): a, c, t, g, unknown or other
  modified_base (8587)..(8589): a, c, t, g, unknown or other
  modified_base (8595)..(8596): a, c, t, g, unknown or other
  modified_base (8601)..(8601): a, c, t, g, unknown or other
  modified_base (8605)..(8605): a, c, t, g, unknown or other
  modified_base (8608)..(8612): a, c, t, g, unknown or other
  modified_base (8616)..(8616): a, c, t, g, unknown or other
  modified_base (8623)..(8623): a, c, t, g, unknown or other
  modified_base (8628)..(8628): a, c, t, g, unknown or other
  modified_base (8630)..(8632): a, c, t, g, unknown or other
  modified_base (8634)..(8634): a, c, t, g, unknown or other
  modified_base (8639)..(8639): a, c, t, g, unknown or other
  modified_base (8664)..(8664): a, c, t, g, unknown or other
  modified_base (8668)..(8668): a, c, t, g, unknown or other
  modified_base (8707)..(8709): a, c, t, g, unknown or other
  modified_base (8713)..(8715): a, c, t, g, unknown or other
  modified_base (8718)..(8718): a, c, t, g, unknown or other
  modified_base (8723)..(8725): a, c, t, g, unknown or other
  modified_base (8727)..(8730): a, c, t, g, unknown or other
  modified_base (8733)..(8733): a, c, t, g, unknown or other
  modified_base (8739)..(8744): a, c, t, g, unknown or other
  modified_base (8748)..(8751): a, c, t, g, unknown or other
  modified_base (8757)..(8757): a, c, t, g, unknown or other
  modified_base (8763)..(8763): a, c, t, g, unknown or other
  modified_base (8774)..(8775): a, c, t, g, unknown or other
  modified_base (8778)..(8778): a, c, t, g, unknown or other
  modified_base (8785)..(8786): a, c, t, g, unknown or other
  modified_base (8805)..(8806): a, c, t, g, unknown or other
  modified_base (8813)..(8813): a, c, t, g, unknown or other
  modified_base (8827)..(8827): a, c, t, g, unknown or other
  modified_base (8844)..(8846): a, c, t, g, unknown or other
  modified_base (8856)..(8857): a, c, t, g, unknown or other
  modified_base (8862)..(8862): a, c, t, g, unknown or other
  modified_base (8869)..(8869): a, c, t, g, unknown or other
  modified_base (8875)..(8875): a, c, t, g, unknown or other
  modified_base (8880)..(8880): a, c, t, g, unknown or other
  modified_base (8886)..(8886): a, c, t, g, unknown or other
  modified_base (8890)..(8890): a, c, t, g, unknown or other
  modified_base (8914)..(8915): a, c, t, g, unknown or other
  modified_base (8927)..(8928): a, c, t, g, unknown or other
  modified_base (8952)..(8952): a, c, t, g, unknown or other
  modified_base (8967)..(8967): a, c, t, g, unknown or other
  modified_base (8981)..(8981): a, c, t, g, unknown or other
  modified_base (8985)..(8985): a, c, t, g, unknown or other
  modified_base (8987)..(8988): a, c, t, g, unknown or other
  modified_base (8992)..(8992): a, c, t, g, unknown or other
  modified_base (8994)..(8994): a, c, t, g, unknown or other
  modified_base (8996)..(8997): a, c, t, g, unknown or other
  modified_base (8999)..(8999): a, c, t, g, unknown or other
  modified_base (9004)..(9004): a, c, t, g, unknown or other
  modified_base (9006)..(9006): a, c, t, g, unknown or other
  modified_base (9009)..(9009): a, c, t, g, unknown or other
  modified_base (9013)..(9013): a, c, t, g, unknown or other
  modified_base (9024)..(9024): a, c, t, g, unknown or other
  modified_base (9027)..(9027): a, c, t, g, unknown or other
  modified_base (9048)..(9048): a, c, t, g, unknown or other
  modified_base (9050)..(9050): a, c, t, g, unknown or other
  modified_base (9067)..(9068): a, c, t, g, unknown or other
  modified_base (9072)..(9072): a, c, t, g, unknown or other
  modified_base (9116)..(9116): a, c, t, g, unknown or other
  modified_base (9121)..(9121): a, c, t, g, unknown or other
  modified_base (9128)..(9129): a, c, t, g, unknown or other
  modified_base (9132)..(9132): a, c, t, g, unknown or other
  modified_base (9135)..(9136): a, c, t, g, unknown or other
  modified_base (9139)..(9140): a, c, t, g, unknown or other
  modified_base (9152)..(9153): a, c, t, g, unknown or other
  modified_base (9156)..(9156): a, c, t, g, unknown or other
  modified_base (9163)..(9164): a, c, t, g, unknown or other
  modified_base (9168)..(9168): a, c, t, g, unknown or other
  modified_base (9171)..(9171): a, c, t, g, unknown or other
  modified_base (9175)..(9175): a, c, t, g, unknown or other
  modified_base (9177)..(9177): a, c, t, g, unknown or other
  modified_base (9202)..(9202): a, c, t, g, unknown or other
  modified_base (9213)..(9215): a, c, t, g, unknown or other
  modified_base (9217)..(9224): a, c, t, g, unknown or other
  modified_base (9234)..(9235): a, c, t, g, unknown or other
  modified_base (9237)..(9237): a, c, t, g, unknown or other
  modified_base (9240)..(9241): a, c, t, g, unknown or other
  modified_base (9248)..(9248): a, c, t, g, unknown or other
  modified_base (9253)..(9253): a, c, t, g, unknown or other
  modified_base (9255)..(9258): a, c, t, g, unknown or other
  modified_base (9264)..(9264): a, c, t, g, unknown or other
  modified_base (9292)..(9293): a, c, t, g, unknown or other
  modified_base (9300)..(9300): a, c, t, g, unknown or other
  modified_base (9305)..(9306): a, c, t, g, unknown or other
  modified_base (9309)..(9309): a, c, t, g, unknown or other
  modified_base (9318)..(9318): a, c, t, g, unknown or other
  modified_base (9321)..(9321): a, c, t, g, unknown or other
  modified_base (9327)..(9329): a, c, t, g, unknown or other
  modified_base (9340)..(9340): a, c, t, g, unknown or other
  modified_base (9344)..(9344): a, c, t, g, unknown or other
  modified_base (9363)..(9363): a, c, t, g, unknown or other
  modified_base (9366)..(9367): a, c, t, g, unknown or other
  modified_base (9378)..(9378): a, c, t, g, unknown or other
  modified_base (9384)..(9384): a, c, t, g, unknown or other
  modified_base (9396)..(9397): a, c, t, g, unknown or other
  modified_base (9400)..(9402): a, c, t, g, unknown or other
  modified_base (9406)..(9406): a, c, t, g, unknown or other
  modified_base (9411)..(9412): a, c, t, g, unknown or other
  modified_base (9420)..(9420): a, c, t, g, unknown or other
  modified_base (9447)..(9447): a, c, t, g, unknown or other
  modified_base (9450)..(9450): a, c, t, g, unknown or other
  modified_base (9465)..(9467): a, c, t, g, unknown or other
  modified_base (9515)..(9515): a, c, t, g, unknown or other
  modified_base (9519)..(9521): a, c, t, g, unknown or other
  modified_base (9526)..(9526): a, c, t, g, unknown or other
  modified_base (9528)..(9535): a, c, t, g, unknown or other
  modified_base (9537)..(9540): a, c, t, g, unknown or other
  modified_base (9542)..(9546): a, c, t, g, unknown or other
  modified_base (9549)..(9557): a, c, t, g, unknown or other
  modified_base (9562)..(9562): a, c, t, g, unknown or other
  modified_base (9564)..(9564): a, c, t, g, unknown or other
  modified_base (9573)..(9573): a, c, t, g, unknown or other
  modified_base (9577)..(9578): a, c, t, g, unknown or other
  modified_base (9587)..(9587): a, c, t, g, unknown or other
  modified_base (9591)..(9591): a, c, t, g, unknown or other
  modified_base (9593)..(9593): a, c, t, g, unknown or other
  modified_base (9601)..(9613): a, c, t, g, unknown or other
  modified_base (9618)..(9618): a, c, t, g, unknown or other
  modified_base (9622)..(9623): a, c, t, g, unknown or other
  modified_base (9625)..(9625): a, c, t, g, unknown or other
  modified_base (9627)..(9628): a, c, t, g, unknown or other
  modified_base (9637)..(9638): a, c, t, g, unknown or other
  modified_base (9642)..(9643): a, c, t, g, unknown or other
  modified_base (9648)..(9648): a, c, t, g, unknown or other
  modified_base (9654)..(9666): a, c, t, g, unknown or other
  modified_base (9919)..(9930): a, c, t, g, unknown or other
  modified_base (9973)..(9975): a, c, t, g, unknown or other
  modified_base (10216)..(10221): a, c, t, g, unknown or other
  modified_base (10239)..(10240): a, c, t, g, unknown or other
  modified_base (10245)..(10245): a, c, t, g, unknown or other
  modified_base (10263)..(10263): a, c, t, g, unknown or other
  modified_base (10284)..(10284): a, c, t, g, unknown or other
  modified_base (10290)..(10290): a, c, t, g, unknown or other
  modified_base (10326)..(10326): a, c, t, g, unknown or other
  modified_base (10331)..(10331): a, c, t, g, unknown or other
  modified_base (10341)..(10341): a, c, t, g, unknown or other
  modified_base (10357)..(10360): a, c, t, g, unknown or other
  modified_base (10398)..(10398): a, c, t, g, unknown or other
  modified_base (10458)..(10459): a, c, t, g, unknown or other
  modified_base (10461)..(10461): a, c, t, g, unknown or other
  modified_base (10472)..(10472): a, c, t, g, unknown or other
  modified_base (10475)..(10476): a, c, t, g, unknown or other
  modified_base (10480)..(10480): a, c, t, g, unknown or other
  modified_base (10486)..(10486): a, c, t, g, unknown or other
  modified_base (10490)..(10490): a, c, t, g, unknown or other
  modified_base (10504)..(10504): a, c, t, g, unknown or other
  modified_base (10506)..(10506): a, c, t, g, unknown or other
  modified_base (10510)..(10510): a, c, t, g, unknown or other
  modified_base (10520)..(10520): a, c, t, g, unknown or other
  modified_base (10525)..(10525): a, c, t, g, unknown or other
  modified_base (10530)..(10530): a, c, t, g, unknown or other
  modified_base (10532)..(10532): a, c, t, g, unknown or other
  modified_base (10542)..(10542): a, c, t, g, unknown or other
  modified_base (10554)..(10554): a, c, t, g, unknown or other
  modified_base (10557)..(10558): a, c, t, g, unknown or other
  modified_base (10561)..(10567): a, c, t, g, unknown or other
  modified_base (10570)..(10570): a, c, t, g, unknown or other
  modified_base (10572)..(10573): a, c, t, g, unknown or other
  modified_base (10575)..(10575): a, c, t, g, unknown or other
  modified_base (10578)..(10587): a, c, t, g, unknown or other
  modified_base (10591)..(10592): a, c, t, g, unknown or other
  modified_base (10594)..(10595): a, c, t, g, unknown or other
  modified_base (10599)..(10604): a, c, t, g, unknown or other
  modified_base (10606)..(10611): a, c, t, g, unknown or other
  modified_base (10613)..(10613): a, c, t, g, unknown or other
  modified_base (10619)..(10620): a, c, t, g, unknown or other
  modified_base (10628)..(10631): a, c, t, g, unknown or other
  modified_base (10633)..(10634): a, c, t, g, unknown or other
  modified_base (10636)..(10641): a, c, t, g, unknown or other
  modified_base (10644)..(10644): a, c, t, g, unknown or other
  modified_base (10647)..(10647): a, c, t, g, unknown or other
  modified_base (10649)..(10650): a, c, t, g, unknown or other
  modified_base (10658)..(10662): a, c, t, g, unknown or other
  modified_base (10667)..(10667): a, c, t, g, unknown or other
  modified_base (10672)..(10677): a, c, t, g, unknown or other
  modified_base (10680)..(10681): a, c, t, g, unknown or other
  modified_base (10683)..(10683): a, c, t, g, unknown or other
  modified_base (10702)..(10725): a, c, t, g, unknown or other
  modified_base (10852)..(10855): a, c, t, g, unknown or other
  modified_base (10859)..(10860): a, c, t, g, unknown or other
  modified_base (10863)..(10863): a, c, t, g, unknown or other
  modified_base (10874)..(10875): a, c, t, g, unknown or other
  modified_base (10884)..(10884): a, c, t, g, unknown or other
  modified_base (10886)..(10888): a, c, t, g, unknown or other
  modified_base (10890)..(10890): a, c, t, g, unknown or other
  modified_base (10908)..(10908): a, c, t, g, unknown or other
  modified_base (10910)..(10910): a, c, t, g, unknown or other
  modified_base (10913)..(10913): a, c, t, g, unknown or other
  modified_base (10931)..(10931): a, c, t, g, unknown or other
  modified_base (10934)..(10934): a, c, t, g, unknown or other
  modified_base (10940)..(10940): a, c, t, g, unknown or other
  modified_base (10954)..(10954): a, c, t, g, unknown or other
  modified_base (10956)..(10956): a, c, t, g, unknown or other
  modified_base (10965)..(10965): a, c, t, g, unknown or other
  modified_base (10981)..(10981): a, c, t, g, unknown or other
  modified_base (10984)..(10985): a, c, t, g, unknown or other
  modified_base (10992)..(10992): a, c, t, g, unknown or other
  modified_base (10998)..(10998): a, c, t, g, unknown or other
  modified_base (11016)..(11016): a, c, t, g, unknown or other
  modified_base (11019)..(11019): a, c, t, g, unknown or other
  modified_base (11023)..(11023): a, c, t, g, unknown or other
  modified_base (11036)..(11036): a, c, t, g, unknown or other
  modified_base (11043)..(11043): a, c, t, g, unknown or other
  modified_base (11055)..(11057): a, c, t, g, unknown or other
  modified_base (11059)..(11059): a, c, t, g, unknown or other
  modified_base (11062)..(11062): a, c, t, g, unknown or other
  modified_base (11064)..(11064): a, c, t, g, unknown or other
  modified_base (11077)..(11077): a, c, t, g, unknown or other
  modified_base (11088)..(11088): a, c, t, g, unknown or other
  modified_base (11091)..(11091): a, c, t, g, unknown or other
  modified_base (11098)..(11100): a, c, t, g, unknown or other
  modified_base (11110)..(11110): a, c, t, g, unknown or other
  modified_base (11118)..(11118): a, c, t, g, unknown or other
  modified_base (11127)..(11127): a, c, t, g, unknown or other
  modified_base (11136)..(11136): a, c, t, g, unknown or other
  modified_base (11143)..(11144): a, c, t, g, unknown or other
  modified_base (11149)..(11149): a, c, t, g, unknown or other
  modified_base (11180)..(11180): a, c, t, g, unknown or other
  modified_base (11193)..(11193): a, c, t, g, unknown or other
  modified_base (11231)..(11232): a, c, t, g, unknown or other
  modified_base (11235)..(11235): a, c, t, g, unknown or other
  modified_base (11243)..(11243): a, c, t, g, unknown or other
  modified_base (11246)..(11247): a, c, t, g, unknown or other
  modified_base (11252)..(11252): a, c, t, g, unknown or other
  modified_base (11256)..(11256): a, c, t, g, unknown or other
  modified_base (11260)..(11260): a, c, t, g, unknown or other
  modified_base (11262)..(11262): a, c, t, g, unknown or other
  modified_base (11268)..(11268): a, c, t, g, unknown or other
  modified_base (11281)..(11281): a, c, t, g, unknown or other
  modified_base (11305)..(11306): a, c, t, g, unknown or other
  modified_base (11326)..(11326): a, c, t, g, unknown or other
  modified_base (11354)..(11355): a, c, t, g, unknown or other
  modified_base (11365)..(11365): a, c, t, g, unknown or other
  modified_base (11372)..(11373): a, c, t, g, unknown or other
  modified_base (11381)..(11381): a, c, t, g, unknown or other
  modified_base (11385)..(11386): a, c, t, g, unknown or other
  modified_base (11390)..(11390): a, c, t, g, unknown or other
  modified_base (11396)..(11396): a, c, t, g, unknown or other
  modified_base (11403)..(11404): a, c, t, g, unknown or other
  modified_base (11424)..(11425): a, c, t, g, unknown or other
  modified_base (11427)..(11427): a, c, t, g, unknown or other
  modified_base (11434)..(11436): a, c, t, g, unknown or other
  modified_base (11460)..(11460): a, c, t, g, unknown or other
  modified_base (11467)..(11469): a, c, t, g, unknown or other
  modified_base (11475)..(11475): a, c, t, g, unknown or other
  modified_base (11477)..(11479): a, c, t, g, unknown or other
  modified_base (11481)..(11481): a, c, t, g, unknown or other
  modified_base (11484)..(11484): a, c, t, g, unknown or other
  modified_base (11491)..(11491): a, c, t, g, unknown or other
  modified_base (11498)..(11498): a, c, t, g, unknown or other
  modified_base (11501)..(11501): a, c, t, g, unknown or other
  modified_base (11506)..(11506): a, c, t, g, unknown or other
  modified_base (11511)..(11511): a, c, t, g, unknown or other
  modified_base (11518)..(11518): a, c, t, g, unknown or other
  modified_base (11524)..(11524): a, c, t, g, unknown or other
  modified_base (11532)..(11532): a, c, t, g, unknown or other
  modified_base (11534)..(11534): a, c, t, g, unknown or other
  modified_base (11550)..(11550): a, c, t, g, unknown or other
  modified_base (11555)..(11556): a, c, t, g, unknown or other
  modified_base (11568)..(11568): a, c, t, g, unknown or other
  modified_base (11583)..(11583): a, c, t, g, unknown or other
  modified_base (11589)..(11591): a, c, t, g, unknown or other
  modified_base (11598)..(11598): a, c, t, g, unknown or other
  modified_base (11600)..(11600): a, c, t, g, unknown or other
  modified_base (11608)..(11610): a, c, t, g, unknown or other
  modified_base (11615)..(11616): a, c, t, g, unknown or other
  modified_base (11620)..(11620): a, c, t, g, unknown or other
  modified_base (11623)..(11623): a, c, t, g, unknown or other
  modified_base (11625)..(11625): a, c, t, g, unknown or other
  modified_base (11629)..(11631): a, c, t, g, unknown or other
  modified_base (11634)..(11634): a, c, t, g, unknown or other
  modified_base (11650)..(11650): a, c, t, g, unknown or other
  modified_base (11656)..(11657): a, c, t, g, unknown or other
  modified_base (11662)..(11664): a, c, t, g, unknown or other
  modified_base (11676)..(11676): a, c, t, g, unknown or other
  modified_base (11679)..(11679): a, c, t, g, unknown or other
  modified_base (11686)..(11687): a, c, t, g, unknown or other
  modified_base (11697)..(11697): a, c, t, g, unknown or other
  modified_base (11719)..(11719): a, c, t, g, unknown or other
  modified_base (11721)..(11721): a, c, t, g, unknown or other
  modified_base (11724)..(11724): a, c, t, g, unknown or other
  modified_base (11729)..(11729): a, c, t, g, unknown or other
  modified_base (11733)..(11733): a, c, t, g, unknown or other
  modified_base (11739)..(11742): a, c, t, g, unknown or other
  modified_base (11745)..(11745): a, c, t, g, unknown or other
  modified_base (11748)..(11748): a, c, t, g, unknown or other
  modified_base (11751)..(11751): a, c, t, g, unknown or other
  modified_base (11758)..(11760): a, c, t, g, unknown or other
  modified_base (11779)..(11780): a, c, t, g, unknown or other
  modified_base (11782)..(11782): a, c, t, g, unknown or other
  modified_base (11795)..(11796): a, c, t, g, unknown or other
  modified_base (11802)..(11802): a, c, t, g, unknown or other
  modified_base (11829)..(11829): a, c, t, g, unknown or other
  modified_base (11836)..(11838): a, c, t, g, unknown or other
  modified_base (11841)..(11841): a, c, t, g, unknown or other
  modified_base (11844)..(11846): a, c, t, g, unknown or other
  modified_base (11850)..(11850): a, c, t, g, unknown or other
  modified_base (11852)..(11852): a, c, t, g, unknown or other
  modified_base (11857)..(11857): a, c, t, g, unknown or other
  modified_base (11859)..(11860): a, c, t, g, unknown or other
  modified_base (11865)..(11865): a, c, t, g, unknown or other
  modified_base (11867)..(11869): a, c, t, g, unknown or other
  modified_base (11878)..(11879): a, c, t, g, unknown or other
  modified_base (11894)..(11894): a, c, t, g, unknown or other
  modified_base (11905)..(11905): a, c, t, g, unknown or other
  modified_base (11909)..(11909): a, c, t, g, unknown or other
  modified_base (11952)..(11952): a, c, t, g, unknown or other
  modified_base (11955)..(11955): a, c, t, g, unknown or other
  modified_base (11961)..(11961): a, c, t, g, unknown or other
  modified_base (11964)..(11964): a, c, t, g, unknown or other
  modified_base (11971)..(11971): a, c, t, g, unknown or other
  modified_base (11976)..(11976): a, c, t, g, unknown or other
  modified_base (11989)..(11989): a, c, t, g, unknown or other
  modified_base (11997)..(11997): a, c, t, g, unknown or other
  modified_base (12001)..(12001): a, c, t, g, unknown or other
  modified_base (12006)..(12007): a, c, t, g, unknown or other
  modified_base (12010)..(12011): a, c, t, g, unknown or other
  modified_base (12020)..(12020): a, c, t, g, unknown or other
  modified_base (12036)..(12036): a, c, t, g, unknown or other
  modified_base (12039)..(12039): a, c, t, g, unknown or other
  modified_base (12058)..(12058): a, c, t, g, unknown or other
  modified_base (12060)..(12060): a, c, t, g, unknown or other
  modified_base (12087)..(12087): a, c, t, g, unknown or other
  modified_base (12096)..(12096): a, c, t, g, unknown or other
  modified_base (12106)..(12106): a, c, t, g, unknown or other
  modified_base (12110)..(12110): a, c, t, g, unknown or other
  modified_base (12114)..(12114): a, c, t, g, unknown or other
  modified_base (12116)..(12116): a, c, t, g, unknown or other
  modified_base (12121)..(12121): a, c, t, g, unknown or other
  modified_base (12124)..(12124): a, c, t, g, unknown or other
  modified_base (12127)..(12129): a, c, t, g, unknown or other
  modified_base (12142)..(12142): a, c, t, g, unknown or other
  modified_base (12148)..(12148): a, c, t, g, unknown or other
  modified_base (12153)..(12153): a, c, t, g, unknown or other
  modified_base (12178)..(12179): a, c, t, g, unknown or other
  modified_base (12187)..(12187): a, c, t, g, unknown or other
  modified_base (12222)..(12222): a, c, t, g, unknown or other
  modified_base (12225)..(12225): a, c, t, g, unknown or other
  modified_base (12231)..(12231): a, c, t, g, unknown or other
  modified_base (12233)..(12234): a, c, t, g, unknown or other
  modified_base (12240)..(12243): a, c, t, g, unknown or other
  modified_base (12268)..(12270): a, c, t, g, unknown or other
  modified_base (12303)..(12304): a, c, t, g, unknown or other
  modified_base (12306)..(12306): a, c, t, g, unknown or other
  modified_base (12309)..(12312): a, c, t, g, unknown or other
  modified_base (12316)..(12317): a, c, t, g, unknown or other
  modified_base (12321)..(12324): a, c, t, g, unknown or other
  modified_base (12326)..(12329): a, c, t, g, unknown or other
  modified_base (12333)..(12333): a, c, t, g, unknown or other
  modified_base (12337)..(12337): a, c, t, g, unknown or other
  modified_base (12339)..(12339): a, c, t, g, unknown or other
  modified_base (12342)..(12343): a, c, t, g, unknown or other
  modified_base (12348)..(12352): a, c, t, g, unknown or other
  modified_base (12354)..(12354): a, c, t, g, unknown or other
  modified_base (12361)..(12363): a, c, t, g, unknown or other
  modified_base (12365)..(12365): a, c, t, g, unknown or other
  modified_base (12367)..(12367): a, c, t, g, unknown or other
  modified_base (12369)..(12369): a, c, t, g, unknown or other
  modified_base (12371)..(12371): a, c, t, g, unknown or other
  modified_base (12374)..(12376): a, c, t, g, unknown or other
  modified_base (12378)..(12380): a, c, t, g, unknown or other
  modified_base (12382)..(12387): a, c, t, g, unknown or other
  modified_base (12390)..(12391): a, c, t, g, unknown or other
  modified_base (12393)..(12393): a, c, t, g, unknown or other
  modified_base (12396)..(12397): a, c, t, g, unknown or other
  modified_base (12399)..(12399): a, c, t, g, unknown or other
  modified_base (12409)..(12409): a, c, t, g, unknown or other
  modified_base (12411)..(12411): a, c, t, g, unknown or other
  modified_base (12414)..(12422): a, c, t, g, unknown or other
  modified_base (12426)..(12427): a, c, t, g, unknown or other
  modified_base (12438)..(12441): a, c, t, g, unknown or other
  modified_base (12446)..(12446): a, c, t, g, unknown or other
  modified_base (12454)..(12455): a, c, t, g, unknown or other
  modified_base (12460)..(12461): a, c, t, g, unknown or other
  modified_base (12465)..(12467): a, c, t, g, unknown or other
  modified_base (12471)..(12471): a, c, t, g, unknown or other
  modified_base (12473)..(12474): a, c, t, g, unknown or other
  modified_base (12479)..(12480): a, c, t, g, unknown or other
  modified_base (12482)..(12482): a, c, t, g, unknown or other
  modified_base (12568)..(12672): a, c, t, g, unknown or other
  modified_base (12787)..(12789): a, c, t, g, unknown or other
  modified_base (12844)..(12972): a, c, t, g, unknown or other
  modified_base (13207)..(14262): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcccggctgcaaagcggatcaatggcaatgtgataaatatgaatggcattcagtgaaatgcattccnnantaccnaanttgcgatggccacantgattgtggcgatggaacngatgagnaannnnncnattgtcccnnggnnnattgttgcgctgannnnnngttccaatgtgccaatggccgacaatgcattccnntcnaatatcnttgcgatggagacnatgattgtggggatnggtcngatgaggaggattnnttntncaagnaanagnctcaatgtnccgcngatnaattccaatgcgccnacnatgcaaaatgcattccgnaagtctggatntgcgatggcgaanatgattgtggggatggaagngatganccggatanttgncacntnccancttgncnggncagcnatttcnaatgcgcnaatngncgntgcattccccncaaattccnttgcgatggagacnangattgnggggatnnntcggangaancnnattgtnnnnncnnnnnntgnccnccnnnnnnntnncgatgcgcccattcccggctttgcctgaacattttgcaattgtgcaatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttnngntngannnnnnnnanatggatggnacaaatcgacnngtnttggtggaaacnnanannnatnnnnnnannnncnttgnnntnganntnnccncnaanngngtntantnnnnngatncnaaantggannnnntngantnngtggactannnnggnaangnnngaaggcaaattgcctctggccgaaattttgcgcctcatccatttggtctggccctcttcgatcaatacttgtattggacggattggacacggctgggcctgatgagggtggagaaatttggcacaaattcggaagtgatttggacgaacaaagagaataatgtgttcccaatgggcattgccgcctaccatcaaatggcacaacctgggccaaaacatgccgactgcttccaacaaccaattgaaaatccgtgcgccaaagcggattgccagggaatgtgcctgcttagcaaagataatgttggcttcggtgtcggtttccgatgtgcatgcccaattggacagnnnnnngttgatggaaagcgttgtgtaccgtccatcgattatttgctgttcagcagcaacaaagttgtgcggggaatctatccggaaatgttgcaaaatgcattggccgaagccgtccttccaatttcgccacagtcccagcgacgaattggaatgtattttgcggttgaatgcgacgtacacggatccagtttcttctatgccgacatcatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtcaatccggaacaattggttcgccgccaattgttgacaaaagtgcgcgaacccctttccattgccgtccatccgtggaagggatttttgttcttcaccgaagccgaccggcctgcccgcgtttggcgctgcaatttggacggacaaggatgcattccaatccggaatcaaacaattggtcgcccatcggggctggccattgattttgccgagaacagactgtgcttgggtgattccctgctgaaaatgttcgcatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcacctcaagcatccatgccatgaacataattgcgcccatttctgctttgccgtgcccaatgaggatcgaacagcgccgttggccaagaaatgtgcctgcaaacaaggatataaagtgaacccgaacaatgaattggcctgtattcgggacattatggaacatattgaaccgttatgccccagaaatgnnnnccaattcnaatgcgcaaatggcngatgcattcccggaacatgganntgcgatggggaaaacgattgtggngatggntcngatgaaacnngcgaaganggnnnngcngccnnttatgananacaatgcnnngaanacannttccaatgcganaatgcngannaatgcattcccggnaaatnnatttgcgatggngacaatgattgcggggatggatcggatgagacgcaggaaatttgcaaaaatncgncanaancnanatgngcggcanacnaattccaatgcgacaatggnaaatgcattccncggcaatggatntgcgatggnganaatgattgtggcgatggatcggatgagaatcaggaanattgccaanaggccccntgcccggaaaaccaattccaatgcgccaatggccgatgcattcccgtcaaatngntttgcgatggngacaatgattgcggggatgggtcggatgagnagcangaaatttgccnagnggccaaatgtaccgcagaccaattccnatgcgccaatggccgaaaatgcattccngtcnaatngnattgcgatggngaagatgattgtggggatggcagngatgaggannnnngtttttgcnangacgaacaatgtgncgcnnaccaattcaaatgtgccancancngccnatgcattcccgtcaaatggnantgcgatggggacnatgattgcggggatggnantgatgaggcccaggngtnntgcaannangngnnaaaatgtncngccgaccaattccaatgcgnnaatggtnaatgcattcccgganaatggatntgcgatggggaaaatgattgcggggatggatcngatgaaannanggaaccaaatnnnacngncnnnnaannnnnnnnannntgtnnnnncnanacaatgnnntgnnnnaatgnnnnngnanaatgcattncnnnnnnnnnnntntgcgatggnnaagannattgcgnggatggannngatganggcggcagatgctcaaggatnttgtgtgccgcggatcgagccggctgccaatataaatgccacaattcgccggagggcccaatttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggcaccgaccttgaagtgttcatcgggcaaggccttgatattactgagggaattgccgtcgactgggttggccgtaacctgtattgggtngattcctcactgaatacaattgaaattggctcattggaaaaaccgggtgcacgttccgtcgttcttcatgaaggtattgancaaccnaggggattagccgttgacccncgngtngcattgatgttttggacggattggggacaacatcccnggattgancgngcaaacatggatggaacaaatcgacaagtgttggtggaaacaaaaatttattggccaaattccattgcactcgatttcaccacaaatcgagtctactttgctgattccaaattggattacattgattttgtggactatgagggcaaaggcagaacacaggtgttggcatccaccaaattcattcaacatccgcatgcaatgtccatcttcgaggatcacatttactacagtgatcgacgacttcaacgccttcaactctatccaaaatatccaaatggcaccacaagggaatatccttcccacacattctcaaaagccctgggcgttgtcaccgtccatccggtccttcaaccacccatcaaggacaatccgtgcgcggccccaccatgcagccatatttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggccggcattgtgccgatcagcggccttcaaaacacctatgatgccgattatgatccactgacaaatgaattattccatttggagcacggcagcacggcaaggctgatggccacgctggtgtccgattcgcgaatttacaaaacaagtttggtgaacaacaatcgaagtcaactgctccaaactggccagccgaatgatccattttgcatggcctatgattggaatggaaggaacttgtatgtgggaaacaaattgtcccaaacaattgaagttgttcgaacacaaggggaacagnnnnnnnnnnnnnnnnnnnnnnnnnnnnnnnnnnnnnnnnnnnnnnnnnnnnnnnnnnnnnnnnnnnnnnnnnnnnnncgaggccttctcttttggttggaccaaggcaaaggtggagtgtcaacaaaggtgnnncgtgccgacatggatggaaataatccgttggtgttggtaaacattgatttggccgagctggatcatttggcgctggacaccnnnaatcgacgcgtctatttcacggaggcaaaggccggtcgcatcacttccgtctcgtacgaaggacaggacaaacattatgtgctgaatgatgccggcaaaagcccagggcaggtggccttcttcaacaatcatttgtactatgccgattcggcattcgacaaagtgatggtgggcgaagtggccggcgatgaacagcagccacgaatttgggaattccgctcctccgttgagcatttggccaatttgaggattgtgcatccggctggggcaggcgaatcgcatccatgccattcaaacaatggaaattgtgaccatatttgcattccgggacaacattccaaattccaatgcatttgggcactgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcccatttcgggtgccgcaatcaccagtgtcgatttccaccacgaatccaaatcaattttctttgtggatgcggccggcctgaacaaaggcatttcgcgctatgttctcggcgaatccgaaccaaggctcattgtgaagaacaattttggtggattcacaatcaaaagtgtggccgtagattgggtcaactacaatttatattttgtgaatgccgacgcggaccgatcgaacattgaagtgagccagctgaatggggagaaccggaaaatattgatgaccacacggacgnnnacacccacctcaattgcggttgacccaattgcccgatggatttattgggcggatcagggccaaacgcccacantnnaaanntgccatatggatgggacaaatcgacgggtattggtggaaacgcatacacatcaagtgagcggcgttgtggtggacattgccgccaaaagggtgtattggtgcgatccaaaagtggacagggtggaatccgtggactactccggaaatgatcgaaggcaaattgcctctggccgaaattttgcgcctggtctggccctcttcgatcaatacttgtattggacggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtaccaaaagggcgaatttgcgaggaaccagacacgttcatgatgttcattgatggggatcgaattgtggatgccaccgttgtgccggacatcaaggccagcagtccattgcgagatgcattccccgcactcccaaatgtgcaattattcgatgtggacgtgaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaattgccaccggcgattggacctatgccctggcattggatccatgctccggattggtgttttggtccgacagtggctacaaggccagtggaggtgcatatnanccnnggattgannggncnaanatggnnggnnnaannngncaannnntngtgnannnnnanntnnnnnngncnnnnncnntngcnntcgatnnnannnnanancgnntctantnngcngatnnnaannngnnnnncattgantnngnggantatganggcnaannnagnnnannnntnggnannggattccgtgcaaaatcactggacatttgggagaattggctttatttgagtgatccactgtcgaatggaatatttcggatgaacaaatttacgggcaacaattatgagagtgtggcacccgaccacagattgccgggcacagtgcgcattttcgggggtgaagcggacattcggacaaggaatcaatgntgcaatgagcataccctgcatttatgtgccaaaaacaacggcggatgcgatcaaatttgccatgttgtttcggatgatttgggcagttccgcgcataaagtgcaatgcgcatgcaatgacacattccaacttgtgaagcaaccgggcgaagacattgccacccaatgcattnnnccaaatgaggccgcaatgaataagccggcatgcgagggcccctacaatttccaatgtgccgacgggaaatgcattncnntgnannnnncntgcgatggannnnnngattgtggngatnnntcggangaggnncnnnnntnttgnnnngnncgantttgccccganaaataattccaatgcgacaancnnnnatgcattccgnangaccnaangtgcgatggacacaangattgtggggatggannngatganntggantgtnacnnnnntgtnccatgtncgganannnanttcanatgtgccaatggccgatgcattccngtcnaatatccttgcgatggagacaatgattgtggggatcggnnntatnnngangaggnnnannnnttntgcaannnnnngccnnnncaatgnggtgcngagaaattccnntgngccaatnnccgccaatgcattcccctnnaatatanttgcgatggagacnatgattgcggggatggnnntgatgaggannagggnttttgcnaaaatnccaantgtgcngccnaccaattcaaatgcgccaatggtnnatgcattcccgnnaaatggaaatgcgatggggacaangattgtggggatggntgggatgaaaccgntgangnntgcncngnncnccaangnaanaaancatgcgtgggngcntaaaagttccaatgcgacaangncaaatgcattccgcggnnatgnatttgcgatggagaagatgattgcggggatggaagtgatgaggngccgntgtaaanntgnccnnatnnaacttgttcggnnaangaattcnnatgngcnaatnanacaatgccatgcaaaaatgcgccgnaatgcattccnnncnnnnnnnnttgcgatggnnangannattgcgnggatngnnnngatgangccgaggcattgtgcaaaaatccggcannacaatgncctgnngancaattccgntgnagaaannncaaatgcattncccncaaatatacttgcgatggngannatgattgcggngatggntcggatgagganncannntgcnaggcnngaaaatgngccgctgacgaattccaatgcgccaancanaaatgcattccggcnnnctggaaatgcgatggccaagatgattgtggggatggcagtgatgaacncgannntggcnannnnnnnncnnnntnnnnnaannnnnnnnnatgcncnaaaggccanttcnnatgccaaantggncnatgcattnnnnnnnnnnnnntttgngacnncnannatgattgcnncganngatcngatgannnnnnnnnnnnngtcgtaaatgaatgcgaaattgcggaacatccactttgtgagcaacgttgcgtggaccaattaattggctataaatgtgattgtgaaaaaggattcaccctaaatcgggaggacaaaaaatcctgtgtggatgtggacgaatgcattgagggattgtcactttgttcacaaatttgtgagaacaaagtgggcagctataaatgtgcatgtgccgatggattcacgctggccgcagatgaatttacttgcaaannnnnnnnnnnncaacaagagccctatttgctgttggccaacaagcattatgtcnnnggaatctcgctggacggatcccgctatgagttggtggcccaaggctttgagaatgttgtctccatggatgtggatccaatcgatgagcaagtctatttgttggatgccggcaaattgcgagtctatcgaaaatcgctgcatcgactgtccgaggctccatccagctatgagcaaattatgcgccataatgtgtttggggtggagggaatcgccgtggattgggtcggacgaaaattgtatnnnnnnaacagacaggacaggtcnntgcgngtttgcgaattggatggncgattttgccggactttgatncgcgancgaattgcccagccaaaggccattgttgtgcacccnaaaangggatatttntacttcagtgaatggnnnntccaaccgtacattgccaaagtggcattggacggctcngctccattcgcggatccaatcatcaaaattgccgaacgcgatttgggctggccaaatgcnntngccatcgattnttnntcanacagantgtnttggggcgatgcananttgnatgagattgnatggntggantnggagggaaangatcgaaggcangtnnccnnnnnnngancnncncannnnnnnnnnctgnncnncttnnnnnnannnnnntnttgganngattggannnngnngnnnnnnatnagngnngagaaatnnnnnggcanaaatnnnnnngtnntnggtgagataaatgaattannnnnnnnnnnnnnnnnnnnnnnncccgttgaggcaacccgctgggccaatccctgcggtgattccaacggtggttgttcccatctttgtttgattggagccggtggccaaaacttctcctgcgcctgccctgaccaattttatttgcttnnnnatgnncgngattgtgaggnnaaatgtgcngnnngncaattcaaatgtagtggnancgnctcaaaatgcattcccanccnatgganttgcgatggagacnangattgtggngatgggagtgatgagnccnnggggttntgcaanggtgagcgaaattgcccngcngacnaattccaatgcgncaatcanaaatgcattccnnngnacngnatttgcgatggcnaaaatgattgnggngatggannngatgagggcnattgtganaaaccatgntgtgcgggnaaattcnnatgcngcgccaatggcaaatgcattccccgaaaatngatgtgcgatggngacaatgattgtggggatgggtcggatgaaaccgatgnntantgcaaaanggnngaacnaaantgcncngaagangaattccaatgcnacaatggcaaatgcattccgcggnnatggatttgcgatggagaanatgattgcggggatggaagtgatgagannctggaatgtnacaatgnnccatgttntgcnnaganattcanatgcggnnacaaccgcaaatgcattccnntntaatatnnntgcgatggagacaatgattgtggngatcggnnngatgangnnnancgnttttgcnaggcacnagncgatnatggngagttcnaatgtngcaccaancntaaatgcattccccgncaatnnatgtgcgatggngacaatgattgtggngatggnnntgatganancgatgaannntgcgnnaatncgncncaannntgngctgcaaagaaattcnaatgcnncaatnnnaaatgcattccngtncaatggnnttgcgatggngacaatgattgcggggatggangngangaggnccantgcaannnncgnaantgntcggccnnnaaattccaatgcgacaatnncngatgcattccggnncattanatgtgcgatggggacaatgattgtggngatggannngangannncaantntgaananngccanannnccccatgcnnggcaaaccaattccnatgcgccaatngccnatgcattccccgcaaatggatttgcgatggggacaatgattgnggngatggntcngatgagnatcangaattatgcaaanatgcccantgtngggcnnacnnccaattccnatgcgccaatggccgnctntgcattcccgtctagtggnantgcgatggggacaatgattgcgggganggggatggngatgatgagnaggnggananttgcnccnacnnnagggaagagggtnaatgtncggcngaccaattccaatgcgccaatggcnnatgcattncggccacatggatttgcgatggccaagatgattgnggngatggnanngatgannnnggttgtgccaaacacaatggcaaannnagctgccattcccattcggacaatggcggatgnnancannnntgcnnggannnntnnnntggntatnantgnnattgnnnnnanggattcnnncnanancnggnnnannnannnnnntgnntnganntngacgaatgcnanggnnnnnnnnnttgnncacaaatttgnnnnaacanaaagggcnnctatnnatgnnnatgngnngatgnntncaattctggtgtgatcatcggggcaatgtcgggcaaagattgccgtgccagtggtgaacctgcgctggtcatgattgcctccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagggagctgatgttttgggtggacacataccaacgaaaattgttccgctccgcattgccaaagggaaatcaatcgcataaggccaggaattgttgattcagatttgaggagnnnaacatttccccattggcaatggcggtggactatttgactgggaatttgttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatttctggccgtttgcaaattccaacagccattgtgacattgccaaaattgggtcgaatttgctatgcggatgccgggttggaagcaaaaattgaatgcgccgacatggatgggaacaaacggcgaacaataatcagtgaattgatatattcaccgaccagtatggccgtggacgaaggacgcgatcatcgaatttattgggccgatccaaaataccacaaagtggattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 636 - DNA, 1293 bp, Artificial Sequence
  Description of Artificial Sequence: Synthetic polynucleotide
  modified_base (1)..(606): a, c, t, g, unknown or other
  modified_base (663)..(663): a, c, t, g, unknown or other
  modified_base (850)..(951): a, c, t, g, unknown or other
  modified_base (1291)..(1293): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattgatattggaattctgccgcctaagggggtcttaatgtatggtccaccagcnactggaaaaacgatgttggctcgcgcagttgccgcccaaaccaaatccacctttctcaaattggctggccctcaacttgtgcaaatgttcattggggatggcgccaaattggttcgggatgccttcgctctggccaaagaaaaagctcctgcaataatattcatcgatgagttggatgcaattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtgatcgctgcaaccaatcgtgttgatgtcctcgacccggcgctgcttcgctctggcagattggatcgtaaaattgagttgccggccccaaatgagaaggcgcggtcccgcattttgcaaatccattcacgtaaaatgaacgttgacaaacacgtcaattttgatgaactcgcacgatgcaccgatgatttcaacggggcccagtgcaaagcggtttgcgttgaagcgggaatgattacacttcgccgtgattcaaatattatcaagcatgaagattttatggacgctattttggaagttcaagccaagaagaagaccacattgaactattatgctnnn

SEQ ID NO: 637 - DNA, 1530 bp, Artificial Sequence
  Description of Artificial Sequence: Synthetic polynucleotide
  modified_base (1)..(660): a, c, t, g, unknown or other
  modified_base (802)..(891): a, c, t, g, unknown or other
  modified_base (974)..(974): a, c, t, g, unknown or other
  modified_base (976)..(976): a, c, t, g, unknown or other
  modified_base (978)..(978): a, c, t, g, unknown or other
  modified_base (1027)..(1029): a, c, t, g, unknown or other
  modified_base (1078)..(1078): a, c, t, g, unknown or other
  modified_base (1080)..(1082): a, c, t, g, unknown or other
  modified_base (1084)..(1085): a, c, t, g, unknown or other
  modified_base (1089)..(1094): a, c, t, g, unknown or other
  modified_base (1098)..(1099): a, c, t, g, unknown or other
  modified_base (1101)..(1101): a, c, t, g, unknown or other
  modified_base (1110)..(1114): a, c, t, g, unknown or other
  modified_base (1116)..(1119): a, c, t, g, unknown or other
  modified_base (1122)..(1122): a, c, t, g, unknown or other
  modified_base (1124)..(1125): a, c, t, g, unknown or other
  modified_base (1128)..(1128): a, c, t, g, unknown or other
  modified_base (1131)..(1137): a, c, t, g, unknown or other
  modified_base (1141)..(1144): a, c, t, g, unknown or other
  modified_base (1146)..(1146): a, c, t, g, unknown or other
  modified_base (1149)..(1152): a, c, t, g, unknown or other
  modified_base (1154)..(1155): a, c, t, g, unknown or other
  modified_base (1249)..(1255): a, c, t, g, unknown or other
  modified_base (1257)..(1262): a, c, t, g, unknown or other
  modified_base (1265)..(1266): a, c, t, g, unknown or other
  modified_base (1269)..(1271): a, c, t, g, unknown or other
  modified_base (1278)..(1278): a, c, t, g, unknown or other
  modified_base (1280)..(1284): a, c, t, g, unknown or other
  modified_base (1288)..(1290): a, c, t, g, unknown or other
  modified_base (1293)..(1294): a, c, t, g, unknown or other
  modified_base (1299)..(1302): a, c, t, g, unknown or other
  modified_base (1304)..(1308): a, c, t, g, unknown or other
  modified_base (1313)..(1313): a, c, t, g, unknown or other
  modified_base (1316)..(1318): a, c, t, g, unknown or other
  modified_base (1320)..(1320): a, c, t, g, unknown or other
  modified_base (1322)..(1322): a, c, t, g, unknown or other
  modified_base (1324)..(1325): a, c, t, g, unknown or other
  modified_base (1330)..(1331): a, c, t, g, unknown or other
  modified_base (1333)..(1335): a, c, t, g, unknown or other
  modified_base (1338)..(1339): a, c, t, g, unknown or other
  modified_base (1341)..(1341): a, c, t, g, unknown or other
  modified_base (1343)..(1343): a, c, t, g, unknown or other
  modified_base (1345)..(1346): a, c, t, g, unknown or other
  modified_base (1350)..(1350): a, c, t, g, unknown or other
  modified_base (1353)..(1353): a, c, t, g, unknown or other
  modified_base (1423)..(1530): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggccacggcaacttctatgattccttcctgaacagcggattgttggacaaattcattaaacaaggggaagaaatatgtttcctttcgaacattgacaatttgggtgccacggtcgacccaaacattctgaattatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatatgaggaacggcttatgctgctggaaattgcgcaagttccgccggactatgtggatgaattcaaatcagtcagcaaatncngnattttcaacaccaataatctttgggccgatttggaagcaatcaagcgannngttgtggaacgggaattgaacatggaagtgattgtgaacccaaaacatntnnncnntggnnnnnntgtnntncaattggannnnncnnnnggngnngcnatnnnnnnnttcnnnngngcnnnngnnatttgtgttcctcgctcgcgttttttaccagttaaatccactcgtgatctattccgaatgcgatcaccgtgcctttttcaattcgacccggacnnnnnnntnnnnnnccnncgnnnattcccnannnnnccgnnngtnnaattnnnnannnnntttgncannntnanannatttnngnnncgnntncnannaatnccngaccttttggaattggatcatttaacggtgtccggcgatgtttggtttggccgagatgtgacattgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 638 - DNA, 849 bp, Artificial Sequence
  Description of Artificial Sequence: Synthetic polynucleotide
  modified_base (1)..(267): a, c, t, g, unknown or other
  modified_base (487)..(519): a, c, t, g, unknown or other
  modified_base (649)..(849): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacattcaaatatgatcatttacggaaggaagcccacgatgcacaaccggctggccaaagagttggaaagcaggaggcttggaggaaggcattgcaaaaggaattggacgaatatatgcgtgaacatttccacgagatgggagtggccactgtgttcacgaaggagaagacgctggttctatgcattgaatcgcatcaattcaagccgaaaaattacnnnnnnnnnnnnnnnnnnnnnnnnnnnnnnnnnccccaattcgatggaaaatcgcattcgcacaaatgcacgggcaaaatgcgactccaagtgcattattatgaggacgggaatgtgcaattgatctcggagaaagaacaacaaattgacgtcaaactcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 639 - DNA, 1413 bp, Artificial Sequence
  Description of Artificial Sequence: Synthetic polynucleotide
  modified_base (1)..(345): a, c, t, g, unknown or other
  modified_base (477)..(477): a, c, t, g, unknown or other
  modified_base (502)..(1413): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgtcaatcccgtttcaatcgccgttccacactctggaaccataaacgcattcacagcgatgcgaagccatttgtgtgcacagtatgccatatgcaattcaaatggaaaaattcactcaaatgccacgangaaatgcatttgcgcaaaaatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 640 - DNA, 1146 bp, Artificial Sequence
  Description of Artificial Sequence: Synthetic polynucleotide
  modified_base (1)..(387): a, c, t, g, unknown or other
  modified_base (546)..(546): a, c, t, g, unknown or other
  modified_base (700)..(702): a, c, t, g, unknown or other
  modified_base (874)..(877): a, c, t, g, unknown or other
  modified_base (933)..(933): a, c, t, g, unknown or other
  modified_base (997)..(1146): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgggattgtcaacgagaatttggtcgaacgattcgcacaggaagtccaagttcccgaggctcgttgcttctatgggtttcaaatcgccattgaaaatatccactccgaaatgtattccaaattgatcgagacatatgtgaagaacgaggatgaacgnaacaaattgttcaatgccattttcgagttcgaattcatcaagaaaaaggccgattgggcgctgcgatggattgcaagccaagaagcaagtttcggtgaacgcctgattgcatttgccgccgttgagggcattttcttctcggggagttttgccnnnattttctggctgaagaaacgtggcctcatgcccggtttgacgcatagcaatgagctgatttcgcgtgacgaaggacttcaccgtgattttgcctgccttctcttccaacatttgaacaataagccaagtgaacaacgtgtccaggaaattgttcgtgaggcggtcacaattnnnnaggaatacttgacggatgcactcccagtggatatgattggaatgaattgccgtctnatgtctcaatatattgaatttgtggccgatcatttgatggtggaactcggcttcgacaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 641 - DNA, 408 bp, Artificial Sequence
  Description of Artificial Sequence: Synthetic polynucleotide
  modified_base (109)..(408): a, c, t, g, unknown or other
atgatttatcaaaaatttgttgaaattggccgtgtagtctatgtggcaaaaggcaaggatactggcaaattggctgtgatcgtgaatgtcatcgacgggaacaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 642 - DNA, 1431 bp, Artificial Sequence
  Description of Artificial Sequence: Synthetic polynucleotide
  modified_base (1)..(279): a, c, t, g, unknown or other
  modified_base (435)..(435): a, c, t, g, unknown or other
  modified_base (466)..(468): a, c, t, g, unknown or other
  modified_base (556)..(585): a, c, t, g, unknown or other
  modified_base (862)..(987): a, c, t, g, unknown or other
  modified_base (1141)..(1431): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttaagtgtgccattgataacaatgaacgaattgtgcgccttttgctcaggtacggggccgatgtgaatgccaaagacacggaacaatggactccgttgcatgcagcagcctgctgtggatacatcgaaattgtgcgccttctcattgatcanaatgccgatttgttggccgtaaatgccgatnnnaatatgccctacgacatttgtgacgatgagcaaacattggacctgatcgaatcggaaatggccgcccgcggcattactcaggtatttnnnnnnnnnnnnnnnnnnnnnnnnnnnnnntgtatttttccagatatgaaacttctacatcagaaaggattgccactggatcaacgaaatccagacaaatcaacatttctccatattgctgctgccaatggatattatgatgtggctgccttcctcctccgttgcaatgtttcgcccgtacttcgggacattgatttgtggcagccaatccatgcggcctcctcatggaatcagccggacctaattgagctactttgtgaatatggagccgacattaatgcgaaaacgggtgcaggcgaaatgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgaatcgccacaacaaccggcctcaactgccgagaatccattctcggccagaggcgccatccggcggcaatctttacgcgatcgaagtggaatgagcctggccagactggaggcacaacgcgaaggatccaatttgtcgcggactttcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 643 - DNA, 1242 bp, Artificial Sequence
  Description of Artificial Sequence: Synthetic polynucleotide
  modified_base (1)..(951): a, c, t, g, unknown or other
  modified_base (1084)..(1098): a, c, t, g, unknown or other
  modified_base (1189)..(1242): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgagaccgaaacctaccatcgatcacggtacacggccatggagagcattgagagcagtatttctgagctgggcacaattttccgccaattggccacactcgtctcggaacagggcgaaatgattacaaggnnnnnnnnnnnnnnngaggaaacggccataaacgttgaggctgcccaccatgaattgctcagatatttcaataatatttcccgcaaccgatggctaatcatcaaannnnnnnnnnnnnnnnnnnnnnnnnnnnnnnnnnnnnnnnnnnnnnnnnnnnnn

SEQ ID NO: 644 - DNA, 1878 bp, Artificial Sequence
  Description of Artificial Sequence: Synthetic polynucleotide
  modified_base (67)..(69): a, c, t, g, unknown or other
  modified_base (154)..(156): a, c, t, g, unknown or other
  modified_base (214)..(1035): a, c, t, g, unknown or other
  modified_base (1873)..(1878): a, c, t, g, unknown or other
atgatagaattattttcaatatttggcaaaggaggactcgtcttgtggtgctttaacgaaggatccnnnaatttcctgaattcaacagtcaacgattttatacgcaatgttgtgacagaaggacggatcgttacatcttttaaccacgaagggnnncatacaataaaatacaaattggataacgagtttgatttgattctcatggtatcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgttgcctctgaaccagcccaaaaaatttgtgattccattggagaaaaattagaaggcaaaataattgggacgttcaatcgagtcacttcaattgtgcgtgattcaatgcgtgaagcactaattcagttgttgacaccaaaacgccgtgtcgacattttgcgcgatattttggatgccaaatcgctgcaacgtccttttgttattgtgttttgtggagtcaatggagttggaaaatctacaaatttggcaaagataactttttggcttaatgaaaatgggcataaagttttgattgccgctggagacactttcagggcaggcgcagttgaacagctccgtactcatgctcatcatctaaatgcactgcatccacaaggcgttcaactatttgagcaaggttacggaaaagatccggcttcgattgcacaatccgcaattcaattggccgctgaacggaaattcgacgttgttttggttgatacggctggcagaatgcaagataatgagcctttgatgagagcattgagcaagctgataaatgtcaataatccggatttgattttgttcgttggcgaggcattggtcggaaatgaagcagtcgatcaattggttaaattcaatcaggcactggccgaccattccactgttgggaataaagcacgtttaattgatggaattgtattgaccaaatttgatacaatcgatgataaggtgggagcagccatttcgatgacctacatcacgggacagccaattatatttgttgggacaggtcaaacctatcatgatattcgaagtttgaatgcaaatgccgttgtgaatagcctattgnnnnnn

SEQ ID NO: 645 - DNA, 402 bp, Artificial Sequence
  Description of Artificial Sequence: Synthetic polynucleotide
  modified_base (1)..(36): a, c, t, g, unknown or other
  modified_base (283)..(283): a, c, t, g, unknown or other
  modified_base (285)..(286): a, c, t, g, unknown or other
  modified_base (289)..(292): a, c, t, g, unknown or other
  modified_base (394)..(402): a, c, t, g, unknown or other
nnnnnnnnnnnnnnnnnnnnnnnnnnnnnnnnnnnngcatttgtgcaacactattacaccaaatttgatgttcccgatgctcaagtccgtacagctggtttaaatgacctctatgatccggagcattcttttatgacttttgaagggaatcaagtgagaggtcgtcaggcaattttggaaaaatttggggttagccatttttgatttatttttaactaatctaattatacggattgtcagccacttcaagacgggtcaatcttggtgacagttattggacagntnnagnnnnatgacgacccgatcaattccttcaaccactgcttcattcttcgtcaaaacactagcggttcattctacatctcgaacgaaatattccgtctggtgcttcatnnnnnnnnn

SEQ ID NO: 646 - DNA, 1938 bp, Artificial Sequence
  Description of Artificial Sequence: Synthetic polynucleotide
  modified_base (1)..(909): a, c, t, g, unknown or other
  modified_base (1033)..(1035): a, c, t, g, unknown or other
  modified_base (1177)..(1938): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcgtcaatatcaatcgaccagcaagaatttttgcgatttgtgcaacaaagatgtttgcaataaatatttcctccggacgcacatgctcaaaatgcacaacattgtgattgacgaaacaaagnnngtgattgccaacattgacacggcggaaaaggaacgtcgcggcgaggtgaaattccgatgtgaaatttgcgggaacagtatgcagacacgggaactgttaaaactgcacaaaagggaagtacatggaatgcagccaattgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 647 - DNA, 945 bp, Artificial Sequence
  Description of Artificial Sequence: Synthetic polynucleotide
  modified_base (1)..(744): a, c, t, g, unknown or other
  modified_base (837)..(837): a, c, t, g, unknown or other
  modified_base (840)..(840): a, c, t, g, unknown or other
  modified_base (847)..(852): a, c, t, g, unknown or other
  modified_base (855)..(855): a, c, t, g, unknown or other
  modified_base (861)..(862): a, c, t, g, unknown or other
  modified_base (864)..(864): a, c, t, g, unknown or other
  modified_base (866)..(870): a, c, t, g, unknown or other
  modified_base (874)..(874): a, c, t, g, unknown or other
  modified_base (876)..(876): a, c, t, g, unknown or other
  modified_base (919)..(945): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgaaatgcgcgattgggtgatgccattaaactttgaccatgccgatgccgaggcaaaacatctcattcatattgccgacgatgacaaaganggnaaattgnnnnnngangaagtnntngnnnnntatnanacatttgttgggtcggaggccaccaattatggggaacatttannnnnnnnnnnnnnnnnnnnnnnnnnn

SEQ ID NO: 648 - DNA, 1440 bp, Artificial Sequence
  Description of Artificial Sequence: Synthetic polynucleotide
  modified_base (1)..(108): a, c, t, g, unknown or other
  modified_base (177)..(177): a, c, t, g, unknown or other
  modified_base (211)..(792): a, c, t, g, unknown or other
  modified_base (939)..(939): a, c, t, g, unknown or other
  modified_base (1086)..(1086): a, c, t, g, unknown or other
  modified_base (1092)..(1092): a, c, t, g, unknown or other
  modified_base (1134)..(1134): a, c, t, g, unknown or other
  modified_base (1174)..(1248): a, c, t, g, unknown or other
  modified_base (1280)..(1281): a, c, t, g, unknown or other
  modified_base (1285)..(1286): a, c, t, g, unknown or other
  modified_base (1368)..(1368): a, c, t, g, unknown or other
  modified_base (1393)..(1440): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaccgaaaagacgagttttggcaatttaaaagatgaggatagaatattcacaaatttatatggcagncacgattatcgattaaagggagcaatggacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgtcgtcgtggaggaagttggtttgctggatttggacgggaaaggaatcgcggaactaagctattttgcatttctggacatgtgaatgagccaacaacggtggaggaggaaatgtccatcccacttcgggatctaatagaacgncatgccggcggagttattggcggttgggacaatttgttgggaataattcctggtggatcctcgtgccgttttgccaaaaagagtatttgcgacaatgttctaatggatttcgatgcattggtccaagtgaattctggattgggcacngctgcngtaattgttatgaataaacagtgcgacattgtgaaatgcatngcccggcttagcatgttttataagcatgaatcttgcgggnnnnnnnnnnnnnnnnnnnnnnnnnnnnnnnnnnnnnnnnnnnnnnnnnnnnnnnnnnnnnnnnnnnnnnnnnnnccacaggaaatcgatatgatttgggagctgannaaannaattgaaggacacacaatttgtgcattgggtgatgcagcggcttggcccgtccaaggattgatacggcatttcagaccaganttggaacgacgaatggccgaatacnnnnnnnnnnnnnnnnnnnnnnnnnnnnnnnnnnnnnnnnnnnnnnnn

SEQ ID NO: 649 - DNA, 666 bp, Artificial Sequence
  Description of Artificial Sequence: Synthetic polynucleotide
  modified_base (1)..(6): a, c, t, g, unknown or other
  modified_base (472)..(666): a, c, t, g, unknown or other
nnnnnngtatttggtagcatctttggtaaaaaaaataccaagcccgtgccgactacacaacaagctctgcaagatttatcagcaacggaagaattattgaccaagaaacaggattttctgaccaaacaaatcgaaacgtcattggcaactgcgaaaaagcatgcttcaaccaacaaaagattggcacttaaagcattgaaggaaaagaaagtccatgaaaaacacctcgaaaagattgaaggaattttgaataccattcatcaccagaaaagttctcttgagaatgctgcattgcatgccgaagtcctcagtgtaatgaccaaaacatctgccgcaatgaaatcaactcatcaaggaatggacgtagacaaggtgcacgatttgatggaggagattgccgaacaacaagaggtttccaatgaaattacacaagcaatcagcaatccaattggactccaaaatgacgttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 650 - DNA, 13353 bp, Artificial Sequence
  Description of Artificial Sequence: Synthetic polynucleotide
  modified_base (1)..(105): a, c, t, g, unknown or other
  modified_base (268)..(2709): a, c, t, g, unknown or other
  modified_base (2848)..(2931): a, c, t, g, unknown or other
  modified_base (3127)..(3132): a, c, t, g, unknown or other
  modified_base (3538)..(3648): a, c, t, g, unknown or other
  modified_base (3745)..(3813): a, c, t, g, unknown or other
  modified_base (3837)..(3837): a, c, t, g, unknown or other
  modified_base (3840)..(3840): a, c, t, g, unknown or other
  modified_base (3844)..(3849): a, c, t, g, unknown or other
  modified_base (3856)..(3862): a, c, t, g, unknown or other
  modified_base (3865)..(3866): a, c, t, g, unknown or other
  modified_base (3869)..(3876): a, c, t, g, unknown or other
  modified_base (3879)..(3889): a, c, t, g, unknown or other
  modified_base (3891)..(3891): a, c, t, g, unknown or other
  modified_base (3894)..(3894): a, c, t, g, unknown or other
  modified_base (3898)..(3898): a, c, t, g, unknown or other
  modified_base (3900)..(3900): a, c, t, g, unknown or other
  modified_base (3903)..(3906): a, c, t, g, unknown or other
  modified_base (3909)..(3909): a, c, t, g, unknown or other
  modified_base (3912)..(3915): a, c, t, g, unknown or other
  modified_base (3918)..(3918): a, c, t, g, unknown or other
  modified_base (3921)..(3922): a, c, t, g, unknown or other
  modified_base (3924)..(3927): a, c, t, g, unknown or other
  modified_base (3929)..(3930): a, c, t, g, unknown or other
  modified_base (3933)..(3937): a, c, t, g, unknown or other
  modified_base (3943)..(3949): a, c, t, g, unknown or other
  modified_base (3955)..(3957): a, c, t, g, unknown or other
  modified_base (3963)..(3963): a, c, t, g, unknown or other
  modified_base (3967)..(3970): a, c, t, g, unknown or other
  modified_base (3973)..(3973): a, c, t, g, unknown or other
  modified_base (3975)..(3975): a, c, t, g, unknown or other
  modified_base (3977)..(3979): a, c, t, g, unknown or other
  modified_base (3986)..(3987): a, c, t, g, unknown or other
  modified_base (3990)..(3990): a, c, t, g, unknown or other
  modified_base (3993)..(3997): a, c, t, g, unknown or other
  modified_base (3999)..(3999): a, c, t, g, unknown or other
  modified_base (4102)..(4188): a, c, t, g, unknown or other
  modified_base (4266)..(4269): a, c, t, g, unknown or other
  modified_base (4272)..(4273): a, c, t, g, unknown or other
  modified_base (4276)..(4276): a, c, t, g, unknown or other
  modified_base (4278)..(4281): a, c, t, g, unknown or other
  modified_base (4287)..(4287): a, c, t, g, unknown or other
  modified_base (4290)..(4290): a, c, t, g, unknown or other
  modified_base (4295)..(4295): a, c, t, g, unknown or other
  modified_base (4297)..(4297): a, c, t, g, unknown or other
  modified_base (4306)..(4308): a, c, t, g, unknown or other
  modified_base (4310)..(4312): a, c, t, g, unknown or other
  modified_base (4315)..(4315): a, c, t, g, unknown or other
  modified_base (4317)..(4323): a, c, t, g, unknown or other
  modified_base (4363)..(4363): a, c, t, g, unknown or other
  modified_base (4365)..(4365): a, c, t, g, unknown or other
  modified_base (4369)..(4372): a, c, t, g, unknown or other
  modified_base (4374)..(4374): a, c, t, g, unknown or other
  modified_base (4376)..(4376): a, c, t, g, unknown or other
  modified_base (4378)..(4378): a, c, t, g, unknown or other
  modified_base (4380)..(4381): a, c, t, g, unknown or other
  modified_base (4383)..(4385): a, c, t, g, unknown or other
  modified_base (4388)..(4388): a, c, t, g, unknown or other
  modified_base (4390)..(4390): a, c, t, g, unknown or other
  modified_base (4392)..(4393): a, c, t, g, unknown or other
  modified_base (4395)..(4395): a, c, t, g, unknown or other
  modified_base (4398)..(4402): a, c, t, g, unknown or other
  modified_base (4404)..(4407): a, c, t, g, unknown or other
  modified_base (4410)..(4412): a, c, t, g, unknown or other
  modified_base (4414)..(4415): a, c, t, g, unknown or other
  modified_base (4417)..(4419): a, c, t, g, unknown or other
  modified_base (4422)..(4422): a, c, t, g, unknown or other
  modified_base (4425)..(4425): a, c, t, g, unknown or other
  modified_base (4434)..(4435): a, c, t, g, unknown or other
  modified_base (4438)..(4439): a, c, t, g, unknown or other
  modified_base (4443)..(4443): a, c, t, g, unknown or other
  modified_base (4513)..(4515): a, c, t, g, unknown or other
  modified_base (4639)..(5217): a, c, t, g, unknown or other
  modified_base (5293)..(5298): a, c, t, g, unknown or other
  modified_base (5323)..(5324): a, c, t, g, unknown or other
  modified_base (5326)..(5328): a, c, t, g, unknown or other
  modified_base (5331)..(5332): a, c, t, g, unknown or other
  modified_base (5334)..(5338): a, c, t, g, unknown or other
  modified_base (5340)..(5341): a, c, t, g, unknown or other
  modified_base (5345)..(5348): a, c, t, g, unknown or other
  modified_base (5350)..(5356): a, c, t, g, unknown or other
  modified_base (5361)..(5363): a, c, t, g, unknown or other
  modified_base (5365)..(5368): a, c, t, g, unknown or other
  modified_base (5370)..(5371): a, c, t, g, unknown or other
  modified_base (5373)..(5375): a, c, t, g, unknown or other
  modified_base (5377)..(5378): a, c, t, g, unknown or other
  modified_base (5380)..(5380): a, c, t, g, unknown or other
  modified_base (5382)..(5383): a, c, t, g, unknown or other
  modified_base (5385)..(5385): a, c, t, g, unknown or other
  modified_base (5387)..(5387): a, c, t, g, unknown or other
  modified_base (5389)..(5391): a, c, t, g, unknown or other
  modified_base (5396)..(5396): a, c, t, g, unknown or other
  modified_base (5400)..(5400): a, c, t, g, unknown or other
  modified_base (5412)..(5412): a, c, t, g, unknown or other
  modified_base (5414)..(5414): a, c, t, g, unknown or other
  modified_base (5420)..(5420): a, c, t, g, unknown or other
  modified_base (5424)..(5424): a, c, t, g, unknown or other
  modified_base (5431)..(5431): a, c, t, g, unknown or other
  modified_base (5433)..(5433): a, c, t, g, unknown or other
  modified_base (5443)..(5444): a, c, t, g, unknown or other
  modified_base (5455)..(5456): a, c, t, g, unknown or other
  modified_base (5460)..(5461): a, c, t, g, unknown or other
  modified_base (5464)..(5465): a, c, t, g, unknown or other
  modified_base (5468)..(5472): a, c, t, g, unknown or other
  modified_base (5475)..(5475): a, c, t, g, unknown or other
  modified_base (5479)..(5479): a, c, t, g, unknown or other
  modified_base (5482)..(5482): a, c, t, g, unknown or other
  modified_base (5484)..(5484): a, c, t, g, unknown or other
  modified_base (5499)..(5499): a, c, t, g, unknown or other
  modified_base (5505)..(5505): a, c, t, g, unknown or other
  modified_base (5507)..(5507): a, c, t, g, unknown or other
  modified_base (5522)..(5522): a, c, t, g, unknown or other
  modified_base (5527)..(5527): a, c, t, g, unknown or other
  modified_base (5529)..(5529): a, c, t, g, unknown or other
  modified_base (5534)..(5534): a, c, t, g, unknown or other
  modified_base (5536)..(5536): a, c, t, g, unknown or other
  modified_base (5539)..(5539): a, c, t, g, unknown or other
  modified_base (5541)..(5541): a, c, t, g, unknown or other
  modified_base (5545)..(5545): a, c, t, g, unknown or other
  modified_base (5547)..(5547): a, c, t, g, unknown or other
  modified_base (5550)..(5550): a, c, t, g, unknown or other
  modified_base (5555)..(5556): a, c, t, g, unknown or other
  modified_base (5559)..(5559): a, c, t, g, unknown or other
  modified_base (5562)..(5562): a, c, t, g, unknown or other
  modified_base (5564)..(5565): a, c, t, g, unknown or other
  modified_base (5568)..(5570): a, c, t, g, unknown or other
  modified_base (5574)..(5574): a, c, t, g, unknown or other
  modified_base (5578)..(5581): a, c, t, g, unknown or other
  modified_base (5587)..(5588): a, c, t, g, unknown or other
  modified_base (5590)..(5592): a, c, t, g, unknown or other
  modified_base (5680)..(5919): a, c, t, g, unknown or other
  modified_base (5989)..(5991): a, c, t, g, unknown or other
  modified_base (6094)..(6096): a, c, t, g, unknown or other
  modified_base (6259)..(6756): a, c, t, g, unknown or other
  modified_base (6922)..(6924): a, c, t, g, unknown or other
  modified_base (7042)..(7044): a, c, t, g, unknown or other
  modified_base (7132)..(7158): a, c, t, g, unknown or other
  modified_base (7253)..(7253): a, c, t, g, unknown or other
  modified_base (7256)..(7257): a, c, t, g, unknown or other
  modified_base (7260)..(7263): a, c, t, g, unknown or other
  modified_base (7267)..(7267): a, c, t, g, unknown or other
  modified_base (7269)..(7269): a, c, t, g, unknown or other
  modified_base (7275)..(7277): a, c, t, g, unknown or other
  modified_base (7279)..(7281): a, c, t, g, unknown or other
  modified_base (7284)..(7284): a, c, t, g, unknown or other
  modified_base (7289)..(7289): a, c, t, g, unknown or other
  modified_base (7294)..(7296): a, c, t, g, unknown or other
  modified_base (7300)..(7307): a, c, t, g, unknown or other
  modified_base (7309)..(7309): a, c, t, g, unknown or other
  modified_base (7311)..(7315): a, c, t, g, unknown or other
  modified_base (7317)..(7321): a, c, t, g, unknown or other
  modified_base (7330)..(7330): a, c, t, g, unknown or other
  modified_base (7332)..(7332): a, c, t, g, unknown or other
  modified_base (7334)..(7335): a, c, t, g, unknown or other
  modified_base (7339)..(7343): a, c, t, g, unknown or other
  modified_base (7345)..(7346): a, c, t, g, unknown or other
  modified_base (7349)..(7349): a, c, t, g, unknown or other
  modified_base (7354)..(7356): a, c, t, g, unknown or other
  modified_base (7358)..(7359): a, c, t, g, unknown or other
  modified_base (7363)..(7365): a, c, t, g, unknown or other
  modified_base (7369)..(7373): a, c, t, g, unknown or other
  modified_base (7375)..(7375): a, c, t, g, unknown or other
  modified_base (7377)..(7377): a, c, t, g, unknown or other
  modified_base (7379)..(7379): a, c, t, g, unknown or other
  modified_base (7381)..(7383): a, c, t, g, unknown or other
  modified_base (7386)..(7386): a, c, t, g, unknown or other
  modified_base (7391)..(7392): a, c, t, g, unknown or other
  modified_base (7395)..(7395): a, c, t, g, unknown or other
  modified_base (7398)..(7398): a, c, t, g, unknown or other
  modified_base (7400)..(7401): a, c, t, g, unknown or other
  modified_base (7404)..(7406): a, c, t, g, unknown or other
  modified_base (7410)..(7410): a, c, t, g, unknown or other
  modified_base (7414)..(7417): a, c, t, g, unknown or other
  modified_base (7423)..(7424): a, c, t, g, unknown or other
  modified_base (7426)..(7428): a, c, t, g, unknown or other
  modified_base (7435)..(7435): a, c, t, g, unknown or other
  modified_base (7508)..(7509): a, c, t, g, unknown or other
  modified_base (7535)..(7535): a, c, t, g, unknown or other
  modified_base (7563)..(7563): a, c, t, g, unknown or other
  modified_base (7569)..(7569): a, c, t, g, unknown or other
  modified_base (7590)..(7590): a, c, t, g, unknown or other
  modified_base (7622)..(7622): a, c, t, g, unknown or other
  modified_base (7639)..(7639): a, c, t, g, unknown or other
  modified_base (7642)..(7642): a, c, t, g, unknown or other
  modified_base (7644)..(7644): a, c, t, g, unknown or other
  modified_base (7647)..(7647): a, c, t, g, unknown or other
  modified_base (7686)..(7686): a, c, t, g, unknown or other
  modified_base (7695)..(7695): a, c, t, g, unknown or other
  modified_base (7710)..(7710): a, c, t, g, unknown or other
  modified_base (7725)..(7725): a, c, t, g, unknown or other
  modified_base (7740)..(7740): a, c, t, g, unknown or other
  modified_base (7746)..(7746): a, c, t, g, unknown or other
  modified_base (7761)..(7761): a, c, t, g, unknown or other
  modified_base (7858)..(8157): a, c, t, g, unknown or other
  modified_base (8335)..(8826): a, c, t, g, unknown or other
  modified_base (9301)..(9303): a, c, t, g, unknown or other
  modified_base (9442)..(9492): a, c, t, g, unknown or other
  modified_base (9676)..(9876): a, c, t, g, unknown or other
  modified_base (10084)..(10086): a, c, t, g, unknown or other
  modified_base (10150)..(10152): a, c, t, g, unknown or other
  modified_base (10255)..(10560): a, c, t, g, unknown or other
  modified_base (10603)..(10605): a, c, t, g, unknown or other
  modified_base (10777)..(11028): a, c, t, g, unknown or other
  modified_base (11227)..(11229): a, c, t, g, unknown or other
  modified_base (11278)..(11280): a, c, t, g, unknown or other
  modified_base (11395)..(12069): a, c, t, g, unknown or other
  modified_base (12316)..(13353): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggagggcaaccaccgaatcgctgttaaccgttgaatgggaaggaattcaaagtggcgaccatccggattcatccattcgtggattcatcgttgaatacagggcggagaaggaaagccaatggaacgtgcattccggtgtcattccttacaaagggccaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcctcgtctcaacaccgaccgtgacaacatcggatggttcattggaggtcgaatggcgttcccagggcaatggccgtggtgttttcggctaccgagttctgtatcgtccaccgggcggtggctggaatccatatgggnnnnnnnnnnnnnnnnnnnnnnnnnnnnnnnnnnnnnnnnnnnnnnnnnnnnnnnnnnnnnnnnnnnnnnnnnnnnnnnnnnnnatccaggcactcgatcgcaactcctacgttctgttcacttcgcccgaagttcgttccactggcaattgccttccgcccacccaaccacctgctcaagtcgccattgatgcaccggatgcagggcatgttcgggtcacctgggctcaattggcacaaagtgcttggttatgcggtcaggcccaagtggaaattcagnnnnnngaaccccgcggcaaacctccagccattcttgatgcccgtcaaagcagccatgttttcgatgcagccccggggcaacgttggtcaattcgagcaaggacccggaatgaggctggccaatcgccatggtccgcttccgtctctgtttccaccctttcctcggctgaacccatcgatgggccattcgtctcatttgcccagggccaacccaggctgagttggcgtggaagggagggtgccgatgaattggttgatcattttgtggtggaatggcggaggaggacggagccaagatggaatcaaattggccgaaaaatcccattcaccggatggcaacgaccgtacaatgcggatttggaccaattggaggctgggcatgtctacgaagtgagagtgcgcgcaatcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacaacttcggctcagttggctccctttggtccaatccgaatggaattgtgaccaactgtggtatgtggtcaagtattccagtgctgaacaacagnnnnnnnnnnnnnnnnnnnnnnnnnnnnnnnnnnnnnnnnnnnnnnnnnnnnnnnnnnnnnnnnnnnnnttccaagtgcaggccgcaaatccngcnggcnnnnnnccatggnnnnnnncgnncannnnnnnnacnnnnnnnnnnncnccnggcncngtnnnnganttnnnngcnganncnnnngnnccnnnnncggtgnnnnnnncttggnnnccgccncaannnncgnangnnnaaatcannggntannnnntngtctacacacttcgttccatcggggaatgcgggccggcttcggcaaaaccaattaccaaatattcacgagagcccaggctggaattggacggacttttgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnggccccactgccccaccagccaatttccgtgtggacaatgtggccgaacaaagtgcagaattgagttggcatgcaccnnnntgnntgnannnnaatggnganatcancnaatatgaannngnnnttncnnnnnnngatgaatggaatcagggcacccgagagggggtaacacccngntccnnnngngncnanntnnncgnantnntnccnnnnncnnnntannncnncnnngtncgngcattcacnnccnncggngccggtccatggtcccaggatttgcgcttcaaaactttgccagccgccattcgagacaacatgccacaannnccacgggtgtatgccaccggaccaagggaggcccagctggtgtggcaaaccagccaaaatcaggcaaactattatgacaaattcgcgtgctcatgggcaccggctggcacaccacaatatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgttcctcattcatggtggaataccggcttgaaaacggcccctggatgcaaatggcccaacggtcccctgcannnnnnctggccgttccacatacaccgccanngnnnggnntnnnnncnnacannnngnnnnnnntgcgnnncnnnntnntnnncnncnannancnannnagtgngccntcgcccgaggtncntgcccntacnaattgtncnccgcccacannaccacccacgnnagtnnccnntgnnnnnccngatngangncaagtccgggtcacntgggcncnattggccaaaagtanttggntntgtgntnagntnaacntnganattgnntancgnannggnnntcanccgnnnngggtgnngnnngtgccaggcgacaaagtggaacacatttttgcctccgaaccgaatacacggtggacagtgcgattgagggcaacaaatcaggtgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggacacggaatacacattgaccggccttctgccaaattccctgtacgaagtgaaggtgcgagcccgannnacggaattgggcccggaggagacacgtgaaggtgccacccttcaacaaccgcccagtgcccctccactcaaccttcaattgacatatgccctcgagcgatcannntctttccaatgggaaccggtggaatgttcgcaaaggcatggcacaattttggcctatgaatatgaaattattggccaagatgattgggccaaattggagaggcaaattgccaacacatcccaaacaagggtgaccatcgatggactcacgccatacacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctttgtagatatcgcctctcctggcaatcaatggcccagccggattcccaacgtttctctaaattgattgaccacccaaaaatggatcatttgattgatggattggagccggaaacaatgtacaatatttccctctccgccggctcaccccacggctttggcnnngaaatttgggctcaattcaaaacggacccattcaaagtgcccgccgtcctccaggcaccaattgtgacaccggaaggagcgcacacattgcacgtggaatggacgggggtggtggaannncagaatcgggtggccggatacattgtcgagattcgaaccagtgacaccaaccaatggactgaggcaaccggcgttgtgagtttggatnnnnnnnnnnnnnnnnnnnnnnnnnnnttggatgggcttgaaccggacaccctgtattttgtgcgaatcaaagtggtggacaacaaccaacgaatcagtgagccatcgccggaggcctcggnccnnacnnnntgtncnccgccnnnannnccncccangggannntcgnnnnnnnncncnnnnngnnnnnaagtccggntnanntggnnnnnannggncaaannnanntggnnntgtnnnnngntnancnnnganattgnntancgnannggnnntcanccgnnnngggtgnngnnngtgccangcgacaaagtggaacacatttttgcctccgaaccgaatacacggtggacagtgcgattgagggcaacaaatcnngcgggccaatcgccatggtcccctcnggtcacattgaccaccaaaggtggcccnccgggngcagtcaaagatttacgtgcngatgccactgggccaacgacggtgttggcaanttggacaccgccgaggnagncngangatgaaatcaccggctacacattggtctacacacttcgntccatcggngaatgcgggccggcntcggcaaaaccaatnaccaaatattcacgngagccnaggctggaattgganggacttttgcccgattccacctatgacatttatgtgaccgcccacacaacgcaggctggaccaaaatccagtgtggtcactgtgaggacggaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcctccgcctacggatttacgcgaggaggaacaattggcccatgccttggaaatttcattccttccaccgcatccaccaaatggcattttggaccaataccggatcagatggacattgcatggaaaattcaattatcaagagaaaagggtgccggcattccagttggaatgttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaaaatgtcgatttccaacaagtccgaattcaatgggagtcaccggaggaggaaacatggaaatgtgaccaagtggaattggctctgcattacacaaattcccgagggcaaacaaagacgacattcccgccggatggacccagagaggtagtcttggattcggtgcccggcacccgttgggaggccaaaatgcgaactcaaaccgtggaaccgggcgaggagcccaaattctcgggatggagcccacgggcggtgttgaccaccaaatcgctgccggaccaaatttttcttgaatgtcacaccaaaaggcccaacccaaggcgaagcatctgggatttgcccgaaggataccaggattggccatggggcgtggatttgcaatacaggctggtgcggctgggaggatgcaaaaaattcgacaaggcactgggcgagccggtcatcatggagaatgtgcaggacaaacaagtgnnnctcgacaatttatatcccggttcggaatatgaagtgaccgtgactttgcggcaaccgcccggcttcgacaaaagaattccacccaaaaaggcggtgcaacgtttccagacggaagaccaaaatccgacggggccacccnnnnnnnnnnnnnnnnnnnnnnnnnnnnnnnnnnnnnnnnnnnnnnnnnnnaaccaaccggaatgcttggaacagaatggcgaaatcagccaatatgaatatgagcttacgggacaggatgaatggaatcagggcacccgagagggggtaacacccaggcaaagggccgacatcggcgaattgatgcccggttcactgtatcgcttcaaagtgcgcgcattcacgtccaccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaggccgatgatttgacctgttccggctaccaaagttccattctcaccgccgaccatttgtgtacaacggtggaaggcttgaagccggccagcacctacagatttgcggttcaagcgcaggctgcctccggcaattggggtccatatacttccgattattttgccaccacccgtccggaatggcgtcaacatgaaggcgggtcgnnncgcttgttgtccgctggccatgacaatttacgcgtgaaatggacaccgccgggtgtgatcgggnnnaacattgaccaatatgaagtgtttatcacggtggccaacaccgccgacccgaatcctcgaagatatgaaacaccgggcacccaaacggattttcatttcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggcaattccattcgattcacggatttgcaaccggaaacgnnntacaatgtgacagtgcaagccggcaccgacgttggctatggccaaatgagttggggcatttgggagacgctggcaccgggcagaacatggattttacggttgaaaagcaaaacgccaagcacattgaccgtcgaatgggatccggtatggggattcgcgcacagtggatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttgggagccagtggaaggcggcggttccacgcactatcaagtgcgctacattcatttgcattccacccgaacactttgggtggaggagccggagaagcacaggaaatatttgctctgccccaaggacccatgcaatcgcctctgctatttggtcttcaatttgccgcatccaccggaggaatatgcatttatggtcnnnagccgtgtggatggcatttggaataattggaagttggccggacggcccnnnaccattgcggatccaccggaagtgaaggagaattgttgcattgtgccaccaccatatcatgtggaaaatattggaatgcacggaaccacctgggatgtgccagtggccccctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaaggatatgcaaaaggattgcgcgattccggtgaacgtggaatgagcacatcaatgtcgaatttggcacaaaggcaacggcagggctattcctcgggctatatgcaaggattcagggatggcaattccggcgtattcggcgacagaatcagcgaaagtttgttgaggcgattggaggaccaatatccggacaatgaggaattccgtgccggctacattgatggattcaaagatggcgtgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 651 - DNA, 1098 bp, Artificial Sequence
  Description of Artificial Sequence: Synthetic polynucleotide
  modified_base (1)..(60): a, c, t, g, unknown or other
  modified_base (172)..(435): a, c, t, g, unknown or other
  modified_base (489)..(489): a, c, t, g, unknown or other
  modified_base (499)..(499): a, c, t, g, unknown or other
  modified_base (528)..(528): a, c, t, g, unknown or other
  modified_base (555)..(555): a, c, t, g, unknown or other
  modified_base (622)..(1098): a, c, t, g, unknown or other
nnnnnnnnnnnnnnnnnnnnnnnnnnnnnnnnnnnnnnnnnnnnnnnnnnnnnnnnnnnngtcgttatgaaaattgtcaaacatggagatattgaattctacgcagggatgtcaaaaatcgctggtgaaacatgccaaggcatattgacaggactgattgccattgaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacccaatcaaaactcgacaaggtaatttgaccatacgcgcctatcgcctcacncgaaaagcantggaactggcatgcaatggggattggtcncctgaatcgactaaacaatctggcctnaatttcggcaattttttcgaggagttaccaattgtggtcaaaaatagtcatttgatgaatgttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 652 - DNA, 399 bp, Artificial Sequence
  Description of Artificial Sequence: Synthetic polynucleotide
  modified_base (1)..(114): a, c, t, g, unknown or other
  modified_base (262)..(399): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccagatccaattgaacatgcttggggaatggagaggaaaatgatgattgcccgattgatgggagacgatcgctatgaacaaaaagtctattattcatcgaaggataccaccagagactacccgaacttattgccaagccatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 653 - DNA, 2397 bp, Artificial Sequence
  Description of Artificial Sequence: Synthetic polynucleotide
  modified_base (1)..(1329): a, c, t, g, unknown or other
  modified_base (1480)..(2397): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactccctccatccaaagagaatttttgtgcgtgaagtgatcgacaaatgcatgcgactttcctaccataaaaagttgttggaaattcttccgaaggaatttgggccaatcattccggatgagccaaatatcagttacattttggacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 654 - DNA, 3381 bp, Artificial Sequence
  Description of Artificial Sequence: Synthetic polynucleotide
  modified_base (1)..(1083): a, c, t, g, unknown or other
  modified_base (1197)..(1197): a, c, t, g, unknown or other
  modified_base (1243)..(1536): a, c, t, g, unknown or other
  modified_base (1581)..(1581): a, c, t, g, unknown or other
  modified_base (1704)..(1704): a, c, t, g, unknown or other
  modified_base (1890)..(1890): a, c, t, g, unknown or other
  modified_base (2074)..(2706): a, c, t, g, unknown or other
  modified_base (2851)..(3159): a, c, t, g, unknown or other
  modified_base (3379)..(3381): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaagttgtggaggatgaccgaagttcccgttccggccttttcccaactggatttccacaagccgaattaccgcctctcgttacaacggaatttatcgctcaggatcaaggncaattcaatcccaaatttatgcgttcaacattatatgccgtcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggctcctatgaatttgtggccaccaaagaatattgcaagganttcaattccgccaaacaaccggcattcatttttatgctcgatgtttcttacaatgccattaaaacaggccttgttgaattgttctgtcgaaatatcaccgaattgttacgcgaattacccaangagaatttccgcgacaaatccacaatgcgaattggcctggccacctacgatcaatccatccatttttacaatttaagccaacccgaagtggaaatgctggttgtgaatgatatttccgacatttttgtgccttttgtcgacggatttcttgttgaatttgaacaggccgaaaaagcattgaacagntgtcttcgcgaaattgtcaacaatttttcaaacactcgaattacggaaacggctttagggccggtgatgcaagctggcttggacgccttgaaaagcgccgatcgagccgggaaattgttaattttccacacttccctgccaacattggaggcacctggccaattaaaaaacagagaggatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatgtgcacaaatattggctgcttatcgggaaaaatgcagtgaatcggcacccatgggccaacttattctgccggaattggccaaacttttgccgctccacgcaaattgtattgttcgccatgactcattgaatggaggttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgccggaacgggacaatgcacattcacgggctgttcgccgcctcgcctacgcaaattcagaacgtgaacggaacttgaagctgttcattgtgaaggagcaggacccgttggaatcatggatgaagaaatttttggtcgaggatcgctatgccaacaatgcacattcctacgtggactttttatgccaaattcatcgagaaattcgatccatcctttcannn

SEQ ID NO: 655 - DNA, 543 bp, Artificial Sequence
  Description of Artificial Sequence: Synthetic polynucleotide
  modified_base (1)..(282): a, c, t, g, unknown or other
  modified_base (490)..(543): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgcttgacccgggtttggcacccgaacatcaacgaggatggaagcatttgtctgagtttgctgcgacaaaattcgctggatggatatgggtggatgccaactcgccgaattcacgatgtgatcctcggacttgatcaactcttcaccgacctcatcgacttcgatgacccttcaatgctcaagctgctcaacatggcaaagcaannnnnnnnnnnnnnnnnnnnnnnnnnnnnnnnnnnnnnnnnnnnnnnnnnnnnn

SEQ ID NO: 656 - DNA, 588 bp, Artificial Sequence
  Description of Artificial Sequence: Synthetic polynucleotide
  modified_base (1)..(147): a, c, t, g, unknown or other
  modified_base (210)..(210): a, c, t, g, unknown or other
  modified_base (394)..(588): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaaggtgcaaaacagtcccgttccgagaagaaggctcgcaaactgttcagcaagcttgtnctgaaacaagtgcacggtgtctcgcgtgtttgcattcgcaagtccaaaaacattctgttcgtcatcaacaaacccgatgtgtacaagagccccggttcggacacgtacattgtttttggcgaggcaaagatcgaggatttggcacagcatgctcagattacggacgtggaaaatttgaaaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 657 - DNA, 1161 bp, Artificial Sequence
  Description of Artificial Sequence: Synthetic polynucleotide
  modified_base (1)..(27): a, c, t, g, unknown or other
  modified_base (34)..(34): a, c, t, g, unknown or other
  modified_base (72)..(72): a, c, t, g, unknown or other
  modified_base (75)..(75): a, c, t, g, unknown or other
  modified_base (153)..(153): a, c, t, g, unknown or other
  modified_base (184)..(819): a, c, t, g, unknown or other
  modified_base (1075)..(1161): a, c, t, g, unknown or other
nnnnnnnnnnnnnnnnnnnnnnnnnnnattttcntgggttttgcccttgaaatggaccaaaatgagctgttntcnttggatcgacaattccttccactcggcaaaattggcggttttcctgcatggcttgacccagtcaatgttccaaaggcngaagaattggcatgttcggtttgttttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggattggaagaaacacgaaaggatgtgaccttcaaacaattcaatcaagcaattggagaggagccggaacaagtgattcgctattggcggggaggagaaccgcaattggccaccgacttttcaccggcacccaaaaatattccccaatgccaattgtgccaatgtccgaggcattttgaattccagctgatgcctcatttgctccaattgattggtgtggattcggtggcacagagtttggattgggtaaatnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 658 - DNA, 2835 bp, Artificial Sequence
  Description of Artificial Sequence: Synthetic polynucleotide
  modified_base (1)..(483): a, c, t, g, unknown or other
  modified_base (658)..(2835): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaggaattatatttgaacaaattgcgctcggcaggaattgagacgaccgatgaacaaaaagcaatatggcgtgacagtgtggaccggataaatagaaaagttgcatacattcgaagaacaggaatggatgaatttcttcgcgacaatcgagactattcccaagttgattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 659 - DNA, 2757 bp, Artificial Sequence
  Description of Artificial Sequence: Synthetic polynucleotide
  modified_base (1)..(1167): a, c, t, g, unknown or other
  modified_base (1239)..(1239): a, c, t, g, unknown or other
  modified_base (1282)..(1287): a, c, t, g, unknown or other
  modified_base (1432)..(2757): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatggaatttgagtagacaattacattggggccataaaattcccgcatattttgttgaaaacacaaaaagntggattgttgccataaatgaagaagaggcccgaaaaagattannnnnnaaattgacccaagatgaggatgtgctggacacttggtttagttcttcattaattccaattgtggttggcggatggccaaaagaaaagcaaattgattatgaaaatctcaatttaatggaaactggccatgatattgtgggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 660 - DNA, 966 bp, Artificial Sequence
  Description of Artificial Sequence: Synthetic polynucleotide
  modified_base (1)..(48): a, c, t, g, unknown or other
  modified_base (76)..(76): a, c, t, g, unknown or other
  modified_base (78)..(81): a, c, t, g, unknown or other
  modified_base (85)..(85): a, c, t, g, unknown or other
  modified_base (87)..(88): a, c, t, g, unknown or other
  modified_base (96)..(96): a, c, t, g, unknown or other
  modified_base (99)..(101): a, c, t, g, unknown or other
  modified_base (103)..(103): a, c, t, g, unknown or other
  modified_base (105)..(107): a, c, t, g, unknown or other
  modified_base (111)..(111): a, c, t, g, unknown or other
  modified_base (117)..(117): a, c, t, g, unknown or other
  modified_base (119)..(123): a, c, t, g, unknown or other
  modified_base (127)..(127): a, c, t, g, unknown or other
  modified_base (133)..(134): a, c, t, g, unknown or other
  modified_base (141)..(141): a, c, t, g, unknown or other
  modified_base (144)..(146): a, c, t, g, unknown or other
  modified_base (150)..(150): a, c, t, g, unknown or other
  modified_base (152)..(152): a, c, t, g, unknown or other
  modified_base (154)..(154): a, c, t, g, unknown or other
  modified_base (162)..(162): a, c, t, g, unknown or other
  modified_base (205)..(495): a, c, t, g, unknown or other
  modified_base (796)..(966): a, c, t, g, unknown or other
nnnnnnnnnnnnnnnnnnnnnnnnnnnnnnnnnnnnnnnnnnnnnnnngtctacactggtccggaaatggatgaanannnntgcntnnatcatccnggnnntncnnntttncatgangnnnnnaaantttggnnatgttgngannnaaanancnccgatttnggggcattcatggaccaagaaggatgtagccgtggaaaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgaaaaagaatgcgtccatcatccgggcaatgccattttccatgaaggaatgaaattttggtcatgttgtgaacgaaaaaccgccgattttggggcattcatggaccaagaaggatgtagccgtggaaaacattgttggattaagaatgaaaaagtggacaatgttcgcgaagattggttccaacgaagtggagaaattcacatttcgatttattgcaaagattcaatccgcgagggaacaaaagtggaaagtgatggaattaatttgagggcaacaatcaaacatggatttggggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 661 - DNA, 1701 bp, Artificial Sequence
  Description of Artificial Sequence: Synthetic polynucleotide
  modified_base (1)..(1029): a, c, t, g, unknown or other
  modified_base (1240)..(1365): a, c, t, g, unknown or other
  modified_base (1567)..(1701): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgatgaaatattggagtcaacgctatcgctactttagcctcttggacgagggaattttgatggacaaacaatgctggttttccgtaacacctgaactgctcgccaagcatgttgctgaacggcttgttcccatcaaaggctgcacaattcttgatcctttcactggttccggttgtaattcaatccaattcgcattgcgcggtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatgatgatccatacccgcttggaatcgacgcagtttatttgagtccaccatggggcggtccttcatattcctcaacgaaggaattcgacattgaaaagggcatggatttgaatggcttcaaaattttcgatacagcaaaacagatctcacaaaacattgcctactttcttccccgaaacacttcagttaatcaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 662 - DNA, 618 bp, Artificial Sequence
  Description of Artificial Sequence: Synthetic polynucleotide
  modified_base (1)..(207): a, c, t, g, unknown or other
  modified_base (360)..(360): a, c, t, g, unknown or other
  modified_base (502)..(504): a, c, t, g, unknown or other
  modified_base (556)..(618): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaaaaaatgctaattgatggtcgatcaatctatgttggcaatgtcgattatagtgccactcctgatcaattggaagaacattttcgtggctgtggttcaatcgagcgagtaacaattctcaccgataaatttactggccatccaaagggntttgcatacattcaattcgcggatccagaaggaatgcaaaattcactctcattaggtgattcactcttcctcggtcgccaaatcaaggttgtcccaaaacgaaccaatcgtccgggaattagcagcaccaatcgaccaccgnnncgtggaagcgggccccgtggacgtgctcgtgttgtaatcaaatatatctatnnnnnnnnnnnnnnnnnnnnnnnnnnnnnnnnnnnnnnnnnnnnnnnnnnnnnnnnnnnnnnn

SEQ ID NO: 663 - DNA, 1002 bp, Artificial Sequence
  Description of Artificial Sequence: Synthetic polynucleotide
  modified_base (1)..(18): a, c, t, g, unknown or other
  modified_base (157)..(234): a, c, t, g, unknown or other
  modified_base (280)..(282): a, c, t, g, unknown or other
  modified_base (426)..(426): a, c, t, g, unknown or other
  modified_base (541)..(1002): a, c, t, g, unknown or other
nnnnnnnnnnnnnnnnnngaagttgataaaataatagaaccatatttggatttgggaaatttgctgctaatcgatcgggacccaattgaaggattgcccaatgaaaaattgaagcaattgacacagaaaaatgtccaattcatgttcaataaaattnnnnnnnnnnnnnnnnnnnnnnnnnnnnnnnnnnnnnnnnnnnnnnnnnnnnnnnnnnnnnnnnnnnnnnnnnnnnnnaaacagattccaaaaccaaaagagccaaccaaatgggagaaatttnnngccaaaaagggaattgtcaaattgaagagaagcaaaaaagtttgggatgaaactgcacaggattggaaaccacgatttggctatcgtcgtgcaaatgagaaaaagtcggattggttgattgaaattcccgacaatgcaggcatnccaaacaaggactattttgctgaaaaagccgatgccaaaagagaacagcaacacaaacaggaatttcaacgattaaaaaacgttgcccggtctgagaaaagcgcgaccaactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 664 - DNA, 1464 bp, Artificial Sequence
  Description of Artificial Sequence: Synthetic polynucleotide
  modified_base (133)..(204): a, c, t, g, unknown or other
  modified_base (322)..(393): a, c, t, g, unknown or other
  modified_base (571)..(573): a, c, t, g, unknown or other
  modified_base (615)..(615): a, c, t, g, unknown or other
  modified_base (688)..(762): a, c, t, g, unknown or other
  modified_base (877)..(879): a, c, t, g, unknown or other
  modified_base (961)..(1464): a, c, t, g, unknown or other
ttgtggacactgaagaatctgggtgacacttggatggtcaaatccatcggaagaaggccaattttattgggcgcattccatcgattgaaggaggaacaaaatgttgaggccattttgcggttggtccaattcnnnnnnnnnnnnnnnnnnnnnnnnnnnnnnnnnnnnnnnnnnnnnnnnnnnnnnnnnnnnnnnnnnnnnnnnaggcccatattgaagcgaattcacaagggaaaaagggcggccaatgatttgtgttcttggggagggcatttggccgaatgcgaaatttcagaggaaaatgtgaacgaaattcaggtgnnnnnnnnnnnnnnnnnnnnnnnnnnnnnnnnnnnnnnnnnnnnnnnnnnnnnnnnnnnnnnnnnnnnnnnnctagtggtttgcattgcgccaatgtatacgtatacggattggcaaattatggtgatgggaattgagacgtggattgcattgggagcggagaaaattattgtgccaatccaatccgcctcctccgatacaatttccattttgagggaatatgaacgaattggcattgttcacattaaannntggccaaaatggccattactctcggatttgaaccctaatganttggtcctatcaaggggaattgaggagtctcacgtgaattgcctgcattttgtaaaaccatttgcggaaatgnnnnnnnnnnnnnnnnnnnnnnnnnnnnnnnnnnnnnnnnnnnnnnnnnnnnnnnnnnnnnnnnnnnnnnnnnnnatttttaaggatatttttggtgagcatccaaatgccggttcacttttattcgagcatcgagatgttcagtttgttttaccggccactcctccacaaaatacattggccaacttcnnntttgattttcttcaacaaactcaatggaaaacaaaatgtaaaatttggcgaatgaaaactcgagttgctgtgaatgcgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 665 - DNA, 393 bp, Artificial Sequence
  Description of Artificial Sequence: Synthetic polynucleotide
  modified_base (1)..(123): a, c, t, g, unknown or other
  modified_base (343)..(393): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagactttcttgaatgaacgcatcaaagtgaacggcaagaccaatcaattggcagctggtggtgtcaaggtggaagcgaccaaaaccaaaattgtcgtcaccgctgagcaacaattctcgaaacgttacctcaaatacttgaccaagaaattcctcaaacgcaattcactgcgagactggctccgtgtcgtggctagcgccaaggatacatatgaggttnnnnnnnnnnnnnnnnnnnnnnnnnnnnnnnnnnnnnnnnnnnnnnnnnnn

SEQ ID NO: 666 - DNA, 834 bp, Artificial Sequence
  Description of Artificial Sequence: Synthetic polynucleotide
  modified_base (1)..(117): a, c, t, g, unknown or other
  modified_base (315)..(315): a, c, t, g, unknown or other
  modified_base (564)..(564): a, c, t, g, unknown or other
  modified_base (566)..(567): a, c, t, g, unknown or other
  modified_base (694)..(834): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccgtgacatagagaagtacttggaaatgtcgctggacagcacccaacgttcttgccaacaattggaatcgtccgataaacttgccgaacaaactgccagagaattattggagcaaagggaaaagttggagaaggctgaaaccaatttggacgaaattcacaagaccacacaatacactcaacggagcctgaactgnctaaaatcgctgttcggcggaatgtttaagaacaaattttctcgactgccaaaggagaaatcgaaagaagaacaacaacagcaggccgatcaattgaccaaaattgtggatcgcgtcaatggcgaaaagcaaggaaatgttgtttcgggtggaaatggaggacaggcagcacattcactgaatgcctcatcgagggctcaaatccaagggacacgttgggaagcaatggacaatcaaattgatcaaaantnngaccaaatgagttctcaactggcacgtcttcgcaattggggcaccgcattgggcgatgaagtggatgatcaaaatcgcctcctcgatcgaatccaaacgaaggctgaacgcaatgatactgtggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 667 - DNA, 369 bp, Artificial Sequence
  Description of Artificial Sequence: Synthetic polynucleotide
  modified_base (141)..(141): a, c, t, g, unknown or other
  modified_base (283)..(369): a, c, t, g, unknown or other
atgaatgcaccgccacgttacgagtcatttcttttggaagaaaaaaaaaggttaaaaattgagagggacacaaaagtgccaaatgccgctgttttcacattcaacaaagaggatcatacacttggaaatttgctgaaatancaattgctcaaagatcccagggttttatttgccggctatcgcaatccacacccattggaacatcgaattctgcttcgaatccaaactgattcgaccacaacaccggctgaggtattggacagtgcgatgaccgatttaattnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 668 - DNA, 270 bp, Artificial Sequence
  Description of Artificial Sequence: Synthetic polynucleotide
  modified_base (36)..(36): a, c, t, g, unknown or other
  modified_base (93)..(93): a, c, t, g, unknown or other
  modified_base (100)..(100): a, c, t, g, unknown or other
  modified_base (102)..(102): a, c, t, g, unknown or other
  modified_base (106)..(107): a, c, t, g, unknown or other
  modified_base (111)..(111): a, c, t, g, unknown or other
  modified_base (118)..(119): a, c, t, g, unknown or other
  modified_base (121)..(121): a, c, t, g, unknown or other
  modified_base (123)..(123): a, c, t, g, unknown or other
  modified_base (126)..(126): a, c, t, g, unknown or other
  modified_base (133)..(133): a, c, t, g, unknown or other
  modified_base (135)..(135): a, c, t, g, unknown or other
  modified_base (138)..(138): a, c, t, g, unknown or other
  modified_base (142)..(142): a, c, t, g, unknown or other
  modified_base (145)..(146): a, c, t, g, unknown or other
  modified_base (149)..(149): a, c, t, g, unknown or other
  modified_base (183)..(183): a, c, t, g, unknown or other
  modified_base (199)..(199): a, c, t, g, unknown or other
  modified_base (201)..(201): a, c, t, g, unknown or other
  modified_base (205)..(214): a, c, t, g, unknown or other
  modified_base (216)..(216): a, c, t, g, unknown or other
  modified_base (222)..(223): a, c, t, g, unknown or other
  modified_base (225)..(225): a, c, t, g, unknown or other
  modified_base (231)..(232): a, c, t, g, unknown or other
  modified_base (234)..(234): a, c, t, g, unknown or other
  modified_base (239)..(240): a, c, t, g, unknown or other
  modified_base (243)..(243): a, c, t, g, unknown or other
  modified_base (255)..(255): a, c, t, g, unknown or other
  modified_base (257)..(264): a, c, t, g, unknown or other
  modified_base (268)..(270): a, c, t, g, unknown or other
atgggtgaccgaaaagcagtcgtcaagaatgcaatnatgaccgatgagatgcaacaagaagcgattgaatgtgccacatcggctctggagaantacaatntngaanngganattgccnncnanatnaaaaagnanttngacnaannctntgggccaacatggcactgcattgttggtcgcaanttcggttcatatgttncncatnnnnnnnnnnanttcatnnanttctanntnggccnngtngccattcttctntnnnnnnnnggannn

SEQ ID NO: 669 - DNA, 1869 bp, Artificial Sequence
  Description of Artificial Sequence: Synthetic polynucleotide
  modified_base (1)..(18): a, c, t, g, unknown or other
  modified_base (132)..(132): a, c, t, g, unknown or other
  modified_base (271)..(1869): a, c, t, g, unknown or other
nnnnnnnnnnnnnnnnnngtttcagccaccaatgaaccaaaacccgatttgaaacctcttcgaattcttgaacttatcaaaaatgcccaacagaaacatggattacggcatgagaattatcagcgatacggnggttattgtggtcgacgtgttgaacgaatccggaagtcattaaaattcactaatcaatataaatgtttgccaaaacgccctggcaaattcattccgcgcgtagtatcacctgaattagttggtgatatcaggttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 670 - DNA, 1257 bp, Artificial Sequence
  Description of Artificial Sequence: Synthetic polynucleotide
  modified_base (1)..(282): a, c, t, g, unknown or other
  modified_base (421)..(585): a, c, t, g, unknown or other
  modified_base (748)..(750): a, c, t, g, unknown or other
  modified_base (805)..(1257): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcgcagccatttttacaatttgtgccaatgaaggagccaaaagagaataccaccaaaacgctgtcaataaacccggaaatcagcggccatgacacatacaaaattgtgttcacggatattggccataatgcaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgagcatgtgttcgttttggattgggcaagttatttctatgaaccggaccatccaaaatttgttgagttatgtaaatgcatttttgaatggacaatacaagaggaaaaattggatattctacattcaaccaggcattttggccctttgacatttatgttannnattaatggtcaaatccatgaacttttgagcttcttttcatccaaaggaaggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 671 - DNA, 1293 bp, Artificial Sequence
  Description of Artificial Sequence: Synthetic polynucleotide
  modified_base (1)..(495): a, c, t, g, unknown or other
  modified_base (562)..(564): a, c, t, g, unknown or other
  modified_base (622)..(622): a, c, t, g, unknown or other
  modified_base (624)..(625): a, c, t, g, unknown or other
  modified_base (628)..(628): a, c, t, g, unknown or other
  modified_base (630)..(630): a, c, t, g, unknown or other
  modified_base (723)..(723): a, c, t, g, unknown or other
  modified_base (787)..(792): a, c, t, g, unknown or other
  modified_base (851)..(851): a, c, t, g, unknown or other
  modified_base (855)..(855): a, c, t, g, unknown or other
  modified_base (861)..(861): a, c, t, g, unknown or other
  modified_base (867)..(867): a, c, t, g, unknown or other
  modified_base (879)..(879): a, c, t, g, unknown or other
  modified_base (888)..(888): a, c, t, g, unknown or other
  modified_base (900)..(900): a, c, t, g, unknown or other
  modified_base (930)..(930): a, c, t, g, unknown or other
  modified_base (939)..(939): a, c, t, g, unknown or other
  modified_base (942)..(942): a, c, t, g, unknown or other
  modified_base (948)..(948): a, c, t, g, unknown or other
  modified_base (957)..(957): a, c, t, g, unknown or other
  modified_base (975)..(975): a, c, t, g, unknown or other
  modified_base (1000)..(1293): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttctttgtgaaattgccaaattttttgagcatcgacactaagccattcgacccggaaacttatnnngatgatgaattggaggaggatgaagtgctcgatgatgagggccgaactcgattgaaantnnagntngaaaatacaattcgatggcgcattgttcgggacgagcagggcaatgagaagcgtgaaagcaatgcccgaattgttcgttggtctgatggccgnatgtcaatgtacttgggcggcgaagtgttcgaggtggacaagcagcgcatcatggacttcaacnnnnnncatttgtacattcgtcagggcgcagctcttcaagcgcaatccgtttttgccgaaaaacncgtntttcgnccacantcaaccgacacnctcactcancgcaaaatgacnatgaacatggcggagaagacgagcaaggcncaaaaagtncgnatgctngcaaatgtnggcgataatccggatgcncagaaaaaggtttgggcacgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 672 - DNA, 1479 bp, Artificial Sequence
  Description of Artificial Sequence: Synthetic polynucleotide
  modified_base (1)..(210): a, c, t, g, unknown or other
  modified_base (286)..(663): a, c, t, g, unknown or other
  modified_base (826)..(1143): a, c, t, g, unknown or other
  modified_base (1273)..(1281): a, c, t, g, unknown or other
  modified_base (1354)..(1479): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactgccttccctgctgaagcaattacaagatgaatgggatgcgacaatgttgaacaattttacacttcgtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctgatattgaccggaggaatggacaaatccattgtgcttttcaatttcgaaaatgataccatcgaaaatacgttcaaagggcatcaaaagcgtgtcacctgcgttcgccttcatccaaatttgaaaaccgtcatttcgggcgcgcaagattctcaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctattgtttcaatggcttattcggaaaatggatattatatggcaacaggatcaaaggatggagaaattattatctgggacctcagaacacaatccaatattgaatcaattgaaatcgaccaatcaatgnnnnnnnnntgtttatcattcgacaattctggaaaatatttagctattggttcctcagccattgaattgtatgaaacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 673 - DNA, 1722 bp, Artificial Sequence
  Description of Artificial Sequence: Synthetic polynucleotide
  modified_base (1)..(405): a, c, t, g, unknown or other
  modified_base (601)..(792): a, c, t, g, unknown or other
  modified_base (871)..(873): a, c, t, g, unknown or other
  modified_base (912)..(912): a, c, t, g, unknown or other
  modified_base (1036)..(1722): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaatccagttgaaaaatattgcttgagtcgggacattctggctgcacaaaaacgtccactaatcaatgagcaactttttgaacattctccgctggttgtgctcaatggattcggcgccgaggggaaaaagcatttgcaattggtgcagaccattttccagaatatgtttcccacaattgatgtcgatcgggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttagtcccggccaattgagcgacagtgaatttgaaggtgaacaagtcgaattggaattaccgcagaacattggcnnngggcgcggcaaaaaacggggccaacaaacgaaattgganctactcgaaattggccctcgaatgagtttgcggttggtcaaaattgaggagggcatcaacgagggggaagtgctctaccatgcccatgtcgccaaaagtagcaaagaaattgctcaacttcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 674 - DNA, 2613 bp, Artificial Sequence
  Description of Artificial Sequence: Synthetic polynucleotide
  modified_base (1)..(741): a, c, t, g, unknown or other
  modified_base (1063)..(2613): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctcgatcgattggaggaatatgtgcattcggcaattgaaaatggacaaaatgtggaccgaaaggtgcttgatgctttgttggcggcaataaatattcaagtccaaaaagagccatattccgttcgaaaattgattctggacaagcagctggtgttgcccaacaccatttcgttcccaccaagccaggtggtcgatatgattgttgaacatgacccggaccatcaattgactcgagtgatcaatcgcatttttggcgaagaacgaccaaaattgacggaaaatgaacgaagagaacgacaacaactgaaagcgcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 675 - DNA, 420 bp, Artificial Sequence
  Description of Artificial Sequence: Synthetic polynucleotide
  modified_base (1)..(3): a, c, t, g, unknown or other
  modified_base (163)..(420): a, c, t, g, unknown or other
nnnattgtgtcgaaaattttggatataggcaaaggaacgggaaattatttgtgtgaagcttacagaattacgttagacccggcaaagccaattcctcggaccaatactcatccaagaatgcccgctcacccatatagttatggggaatatgtgagtttatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 676 - DNA, 2385 bp, Artificial Sequence
  Description of Artificial Sequence: Synthetic polynucleotide
  modified_base (1)..(258): a, c, t, g, unknown or other
  modified_base (403)..(879): a, c, t, g, unknown or other
  modified_base (897)..(897): a, c, t, g, unknown or other
  modified_base (921)..(921): a, c, t, g, unknown or other
  modified_base (991)..(1086): a, c, t, g, unknown or other
  modified_base (1156)..(1158): a, c, t, g, unknown or other
  modified_base (1212)..(1212): a, c, t, g, unknown or other
  modified_base (1215)..(1216): a, c, t, g, unknown or other
  modified_base (1218)..(1219): a, c, t, g, unknown or other
  modified_base (1221)..(1221): a, c, t, g, unknown or other
  modified_base (1276)..(1278): a, c, t, g, unknown or other
  modified_base (1381)..(1521): a, c, t, g, unknown or other
  modified_base (1585)..(1716): a, c, t, g, unknown or other
  modified_base (1726)..(1726): a, c, t, g, unknown or other
  modified_base (1734)..(1734): a, c, t, g, unknown or other
  modified_base (1746)..(1746): a, c, t, g, unknown or other
  modified_base (1791)..(1791): a, c, t, g, unknown or other
  modified_base (1798)..(2139): a, c, t, g, unknown or other
  modified_base (2287)..(2385): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaacgaacttggcgagaaatataattccgtggcagacaaaacatcatccctgcacgatgcctgtgatcgaatgatgtcggaacaaacacaattggctgcggcaaatgagaggatcagtgcaagtttgcattattatcaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctttgccaacgccancaacaatcttcgtgcacattaacncgtgatggttgcactttcctccttcgcctttgcgatgatgaatttcgtctttatcgacaattttttgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattccacaaatccattcactgaattcattgagggcctctgccgaattctctatgacactttacggcccnnnataatccacaatcctcatttggaaacattggcccaactttgcactttattaaangtnnanntnattgatgaacgttgtggaatgcctcagccaattggtgccgaaattgttgatgccnnncaacaattggaaatgggattggcaaatccaagggccggttttgctcgggtgatcagcgaattggttgcggacattgtggaacgaattgtttataggcaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttcgcccattgaccaacattgtctttggtatccgacggtcaaaaggacggtgatgtgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgtgcgntggacgcngaattgttcatngtcaaacatttgctgattttgagggaacaaaccagtccatatcgncaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcacgatcaatgctcccaagcattcaaacaactcaaacagaattggccacaaattcgttcggcattcagcctctacattggggtgagggagacggaagagattttgttgcagccaattcgacgtgcaatttccaatgcattttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 677 - DNA, 1101 bp, Artificial Sequence
  Description of Artificial Sequence: Synthetic polynucleotide
  modified_base (1)..(129): a, c, t, g, unknown or other
  modified_base (499)..(630): a, c, t, g, unknown or other
  modified_base (696)..(696): a, c, t, g, unknown or other
  modified_base (874)..(879): a, c, t, g, unknown or other
  modified_base (987)..(987): a, c, t, g, unknown or other
  modified_base (1084)..(1101): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgggatgtgaacaattacaaagaacaaatttgtattcgaattgtcaatcaaagtccaaatggtttggatttggactttgatttggtgaatgttgaagcaccgattgccaatgctcttcgccggattttaatagcgagggtaccaaccatggccattgaaaaagttttcctctatcagaacacatcatgcattcaggatgaagttctttgccatcgtcttggcctaatccccattaaagcggatccaacaaaatttgcatttccgctggccacaaattcaaatgccgcccaacaaccgctgaaccttgatgaggaaccagccggcgaaccaaagaggaatttaatattcgaattgaatgttgtctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacaaatggtccataaggacattattttggccaaaatgcgtccgggacaagaaattgaagccagntgccattgtgtgaaaggcattggaagagaccatgcaaagttttcgcctgtcgcaaccgcaacctaccgaatgctgcctcaaattaaattgaaaagagactttgacgatgaacaatttggccgacttcaatcgagtttttcaaatggagtaattggaaaggatgaacgaaccggacggnnnnnngcatatgtgaaggatgcgagggcagacacatccagtaggaatatttacatgcacgatgatttgaaggatgccgtggaaatgggcaaaaagaagacacattttattttnagtgttgagtcaaccggcgcaatgcccgccaacaaattggtttgggaagcgtgtgagattatgaaaaagaaggcagaaagtttgcgcaaaaatattnnnnnnnnnnnnnnnnnn

SEQ ID NO: 678 - DNA, 1869 bp, Artificial Sequence
  Description of Artificial Sequence: Synthetic polynucleotide
  modified_base (1)..(135): a, c, t, g, unknown or other
  modified_base (348)..(348): a, c, t, g, unknown or other
  modified_base (357)..(357): a, c, t, g, unknown or other
  modified_base (369)..(369): a, c, t, g, unknown or other
  modified_base (375)..(375): a, c, t, g, unknown or other
  modified_base (408)..(408): a, c, t, g, unknown or other
  modified_base (456)..(456): a, c, t, g, unknown or other
  modified_base (468)..(468): a, c, t, g, unknown or other
  modified_base (546)..(546): a, c, t, g, unknown or other
  modified_base (813)..(813): a, c, t, g, unknown or other
  modified_base (1294)..(1296): a, c, t, g, unknown or other
  modified_base (1426)..(1426): a, c, t, g, unknown or other
  modified_base (1428)..(1428): a, c, t, g, unknown or other
  modified_base (1525)..(1525): a, c, t, g, unknown or other
  modified_base (1579)..(1579): a, c, t, g, unknown or other
  modified_base (1681)..(1683): a, c, t, g, unknown or other
  modified_base (1685)..(1687): a, c, t, g, unknown or other
  modified_base (1689)..(1693): a, c, t, g, unknown or other
  modified_base (1695)..(1697): a, c, t, g, unknown or other
  modified_base (1843)..(1869): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaagagctggacgcggtcatggatgtgctgcacaaagtggagctggacaatgcgaaagcacgcgctgttgctggtgttctgacttcacagccgagaagtattaacctgaagattgaacaattgaccatcactttccatggacgcgaaatcgttacggacacaaccttggagatcaacatgggccgtcgttatggactcattggacttaangggagcgcnaaatcctcactnatgcangcaatttacatgcgcgagatgccaatcccagancatattgacatgttccttgtcagccgagaaatggctgccgttgattcnactgcactccangcagtgattaatgtcgacaaagagcgtataattcttgagaaacaggcggaggagttggcagcttacggtgatgaaganagccaaacaaaattgttggacatttatgaaagactggacgaaatggacgcggataaggcggaagtcaaggcggctgaaattttacatgggcttggctttactccacaaatgatgcaaaagcggtgcaaggatttctctggtggctggcgaatgcgcatcgctttggcacgcgctctttacctaaaaccatctcttttgctgctggatgagcccacaaaccatttggatctggacgcttgtgtgtggcttgagggacaactttcaaantacaagcggtcacttctaatcatttcccactcgcaagacttcatgaacaatgtttgcacaaatgtaatccatctcatcaataagaaacttgtttattacacgggcaattatgacacctttgtgaaaacccggttagaattgctggaaaaccaggcgaaacgctacaattgggagcaggcgcaaatcaaacacatgaaggaatatgtggctcgttttggccatggaagtgcaaaactggctcgtcaagctcagagcaaagagaaaacaatggcaaaaatgattgccggtggattgacggacaaagttgtgttggagcaaacgaagcagttctacttctttgaacccgacaatataccgccgccagtcatcatggtccagcatgtttctttccgctacaagaatgattcgccctggatctaccgagacctggattttggcattgatttggatacgcgagtggcattggttgggccgaatggannnggcaaatcaactcttctcaaactgcttgccggagacatagagcccacagatgggatgatcagaaggcacttgcactgcaaaatcggcaaataccatcaacatttggttgaagagttgccattggaactgngngcactggattacatgcagagggagttcccggatgttcgcgagaaggaggaaatgcgcaaaatcatcggacgctatggactttccgggcgggagcagntttgcccaatgaaacaactctcggatggccaacgctgtcgagttgcttttgccngcctagcttggcagcagcctcacctgttgttgtttgatgagcctaccaatcatttggacatggaaagcatcgatgcattggccgaggcaatcaacaattttnnngnnngnnnnntnnnggtatcccacgacttccggcttgttcagcaagtgactgaggagatttgggtttgcgaccgtcagacaattaccaaatgggatggcgacatcttcacgtacaagcaacatctccgcgacaggattgaagacaacgaccgcaagaagnnnnnnnnnnnnnnnnnnnnnnnnnnn

SEQ ID NO: 679 - DNA, 2139 bp, Artificial Sequence
  Description of Artificial Sequence: Synthetic polynucleotide
  modified_base (1)..(78): a, c, t, g, unknown or other
  modified_base (90)..(90): a, c, t, g, unknown or other
  modified_base (96)..(96): a, c, t, g, unknown or other
  modified_base (135)..(135): a, c, t, g, unknown or other
  modified_base (144)..(144): a, c, t, g, unknown or other
  modified_base (156)..(156): a, c, t, g, unknown or other
  modified_base (183)..(183): a, c, t, g, unknown or other
  modified_base (186)..(186): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (226)..(228): a, c, t, g, unknown or other
  modified_base (232)..(232): a, c, t, g, unknown or other
  modified_base (234)..(234): a, c, t, g, unknown or other
  modified_base (237)..(237): a, c, t, g, unknown or other
  modified_base (243)..(243): a, c, t, g, unknown or other
  modified_base (249)..(249): a, c, t, g, unknown or other
  modified_base (252)..(252): a, c, t, g, unknown or other
  modified_base (282)..(282): a, c, t, g, unknown or other
  modified_base (300)..(300): a, c, t, g, unknown or other
  modified_base (378)..(378): a, c, t, g, unknown or other
  modified_base (389)..(390): a, c, t, g, unknown or other
  modified_base (417)..(417): a, c, t, g, unknown or other
  modified_base (427)..(427): a, c, t, g, unknown or other
  modified_base (429)..(435): a, c, t, g, unknown or other
  modified_base (438)..(438): a, c, t, g, unknown or other
  modified_base (442)..(450): a, c, t, g, unknown or other
  modified_base (591)..(591): a, c, t, g, unknown or other
  modified_base (648)..(648): a, c, t, g, unknown or other
  modified_base (657)..(658): a, c, t, g, unknown or other
  modified_base (660)..(661): a, c, t, g, unknown or other
  modified_base (663)..(663): a, c, t, g, unknown or other
  modified_base (678)..(678): a, c, t, g, unknown or other
  modified_base (834)..(834): a, c, t, g, unknown or other
  modified_base (865)..(865): a, c, t, g, unknown or other
  modified_base (867)..(867): a, c, t, g, unknown or other
  modified_base (894)..(894): a, c, t, g, unknown or other
  modified_base (897)..(897): a, c, t, g, unknown or other
  modified_base (903)..(903): a, c, t, g, unknown or other
  modified_base (931)..(931): a, c, t, g, unknown or other
  modified_base (945)..(945): a, c, t, g, unknown or other
  modified_base (954)..(954): a, c, t, g, unknown or other
  modified_base (1038)..(1038): a, c, t, g, unknown or other
  modified_base (1269)..(1269): a, c, t, g, unknown or other
  modified_base (1302)..(1302): a, c, t, g, unknown or other
  modified_base (1326)..(1326): a, c, t, g, unknown or other
  modified_base (1350)..(1350): a, c, t, g, unknown or other
  modified_base (1362)..(1362): a, c, t, g, unknown or other
  modified_base (1380)..(1380): a, c, t, g, unknown or other
  modified_base (1407)..(1407): a, c, t, g, unknown or other
  modified_base (1425)..(1425): a, c, t, g, unknown or other
  modified_base (1446)..(1446): a, c, t, g, unknown or other
  modified_base (1449)..(1449): a, c, t, g, unknown or other
  modified_base (1455)..(1455): a, c, t, g, unknown or other
  modified_base (1470)..(1470): a, c, t, g, unknown or other
  modified_base (1473)..(1473): a, c, t, g, unknown or other
  modified_base (1506)..(1506): a, c, t, g, unknown or other
  modified_base (1509)..(1509): a, c, t, g, unknown or other
  modified_base (1563)..(1563): a, c, t, g, unknown or other
  modified_base (1587)..(1587): a, c, t, g, unknown or other
  modified_base (1596)..(1596): a, c, t, g, unknown or other
  modified_base (1623)..(1624): a, c, t, g, unknown or other
  modified_base (1626)..(1626): a, c, t, g, unknown or other
  modified_base (1638)..(1638): a, c, t, g, unknown or other
  modified_base (1671)..(1671): a, c, t, g, unknown or other
  modified_base (1707)..(1707): a, c, t, g, unknown or other
  modified_base (1710)..(1710): a, c, t, g, unknown or other
  modified_base (1713)..(1713): a, c, t, g, unknown or other
  modified_base (1755)..(1755): a, c, t, g, unknown or other
  modified_base (1794)..(1794): a, c, t, g, unknown or other
  modified_base (1854)..(1854): a, c, t, g, unknown or other
  modified_base (1899)..(1899): a, c, t, g, unknown or other
  modified_base (1968)..(1968): a, c, t, g, unknown or other
  modified_base (1980)..(1980): a, c, t, g, unknown or other
  modified_base (2016)..(2016): a, c, t, g, unknown or other
  modified_base (2019)..(2019): a, c, t, g, unknown or other
  modified_base (2088)..(2088): a, c, t, g, unknown or other
  modified_base (2131)..(2139): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnntcagatttgctnaaaganaatgaagatgaccttgccaccgtggatgacgtgttcgangcggtcggngagcacattcanggatttgcggatgatttgagcagaggngangtgganganatctgncagaagcttttggctttattgcatnnngacngnaangagaangcgccnacnactcgcgtgctggaagcccgaaagttggancaaaccgtggacatgagncagcaaagcgaaacattcaaactgatggacaatttgtggaaagttacgcccaatgatgtgccgcttcaggttgacaanaagaaactggnnaaagccgaagataaagccaaggaaaanatgcaaaagnannnnnnngcnccannnnnnnnnaaaaggcaaagaccgcacatccaggcaacagcaagtcaagcgatgaacagaagagatgcgaaaggagaggtcggcaatttggacataaagctggagaatgtcgacatttcctttgggaacaaaatgcttctgtccggcgcngaactctctcttgtctacgggcacagatatggacttgtgggacggaatggcattggnaaaacaacnntnntnaaaatgatttccagnaagcaattgatcatcccctcaaacatcacattcttgagtgtggagcaagaagttgaaggtgatgacacacccgtgattgacgccgttcttgcatccgatctgaaaagagtgcaactgctgacggaagagcgcgaattgcaagcaaaaataaacagncctgacacgccggatgaccaaagaactgcantntcggcccgactggatgcagtttacgcngancagcanaatcttcaactggacaaagcgccagccngagcagcaaccatnctttttggncttgggttcaagccggacgagcagcggaagccaacaaaggaattttctggtggctggagaatgcgtgttgcgctggcccgtgcncttttcataaaacccgatttactgttattggacgaacccactaacatggttgacatgcgcgccgtttactggctggaaaaccatttacaggagtggacgggcacaatactaacagtttcccacgaccggaaatttttgaacaccgtttgcactgacattgtccatttgcactccaggcggttggacgcatacaagggcaattacgataattatgataagacaatgcgcganaaactgacccaacaacaacgcgactacgagtcncaacaacaatacagacagcatgtncaggagttcatcgacaaattccgntacaacgccaancgcgcttccatggtgcantcgaggataaaaatgcttgaaaaattncccgtcctacaaccggtngaatttgagtcggccgtgacnttncaattnccggactgcgagaanttnggcaatccagttttgcagcttgatgagatggcnttncgctacaccaaagaatcgtcttatattttccagaaagtctgcattggctcccgntccgattcgcgcatttgcattgtnggcgaaaanggggccggcaaaacaacgctgttgaanntnctgcttggcganctggaagccacttcgggtgtgcggaacgcaaancgtcgcctcaacattggctacttcacccaacaccangtngancagttggaaatggacgaaaccccgttggagttgttggcccancgattcccgggcatgaatgaggaagactatcgatccgcnatgggacgttttggtctgagcggggatatcgcatttcagcccattgtcacactttctgtnggccaaaagtccaggctggcatttacgtgtttgtccctgcaaaancccaactatttgataatggacgagcccaccaaccatttggacgtggaaactgttgacgcactgggcaangcgttgaacaanttcaaaggcggcgtggttttggtgtcccacgacgancgnctcatcgagttggtctgcaaagagctttgggtgtgcaaagacaaaacggtgactcaactggacggcggnttggaggagtacaagaagcatgtgtaccggcaactggccattnnnnnnnnn

SEQ ID NO: 680 - DNA, 1710 bp, Artificial Sequence
  Description of Artificial Sequence: Synthetic polynucleotide
  modified_base (1)..(177): a, c, t, g, unknown or other
  modified_base (699)..(699): a, c, t, g, unknown or other
  modified_base (702)..(702): a, c, t, g, unknown or other
  modified_base (734)..(735): a, c, t, g, unknown or other
  modified_base (741)..(741): a, c, t, g, unknown or other
  modified_base (978)..(978): a, c, t, g, unknown or other
  modified_base (1041)..(1041): a, c, t, g, unknown or other
  modified_base (1219)..(1266): a, c, t, g, unknown or other
  modified_base (1273)..(1273): a, c, t, g, unknown or other
  modified_base (1362)..(1362): a, c, t, g, unknown or other
  modified_base (1459)..(1710): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctagctgctgcacgtaaatctttccaaagatgggcgcatgaatttacagcgatagagaggggagcagtactccagaaatggttcgaaatcatgaagatcaaagaacaacaattggcggaattgcttaccaaagaacagggcaaagcattgtctgaatcacgcgcagagatccaatattccgcttctttctttgagtggtacgctggcgaagctcgtcgcatttatgggcaaattgtgccaccatcaaaactcaatcgacaacactttcatgttcgcgagcccatcggagtggtggccgtgataactccatggaactttccaagtgcaatgattgctcgcaaagttggcgccgcattggctgctggctgcacagttattgtgaagccggcggaggacaccccactttctgcgcttgccttggcagaaatatcccaagaagccggagtgccaaatggcgtcttcaatgtaattccagcggatcgggaacagaccgcagaaatttcaaagtttatttgcgantcncatgatgttgactgcatttcgttcacaggcanntcagcngttggaaagattcttttgagtcaatcagcgtccacagtgaaaagggtttgccttgagcttggcgggaacgcaccattcattgttttcaagggtgctgatattgataaggctgttcagggagcaattgcatcaaaattccgttgttccggccaaacttgcgtttcagcgaatcgctttttcatagaaaagccaatctgcgatgagttcgttgccaaactcaaggagaaagtgaaaganaagttgaaatacggcaatgggatggacaaaaacgtcgaccaagggcccctgatcaatcaaaangcagtcgacaaagtggcggatttggtcaaggatgcgctagagaagaaggccgaactgatttgtggaggcgaagttgttccagacacgaccatcttcaagccgacgatattgacaaaagtgaatagcgagatggagatagcaaatgccgaaatatttggaccagtcattgccgtgcaannnnnnnnnnnnnnnnnnnnnnnnnnnnnnnnnnnnnnnnnnnnnnnnataaaanttttaggatatgcttacacgaaggaattaggacaaatatatcgtctcactcgctctatccaagttggaatgctgggcataaatgaaggngtgatttcttgcgcggaagcagcctttggaggcgtcaaagaagccggtttgggccgagaaggaggtcaacaaggaattgacgaattcacccaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 681 - DNA, 2907 bp, Artificial Sequence
  Description of Artificial Sequence: Synthetic polynucleotide
  modified_base (1)..(69): a, c, t, g, unknown or other
  modified_base (252)..(254): a, c, t, g, unknown or other
  modified_base (259)..(261): a, c, t, g, unknown or other
  modified_base (267)..(269): a, c, t, g, unknown or other
  modified_base (273)..(275): a, c, t, g, unknown or other
  modified_base (277)..(277): a, c, t, g, unknown or other
  modified_base (279)..(279): a, c, t, g, unknown or other
  modified_base (282)..(282): a, c, t, g, unknown or other
  modified_base (294)..(294): a, c, t, g, unknown or other
  modified_base (301)..(301): a, c, t, g, unknown or other
  modified_base (303)..(303): a, c, t, g, unknown or other
  modified_base (306)..(306): a, c, t, g, unknown or other
  modified_base (315)..(315): a, c, t, g, unknown or other
  modified_base (321)..(321): a, c, t, g, unknown or other
  modified_base (328)..(330): a, c, t, g, unknown or other
  modified_base (334)..(335): a, c, t, g, unknown or other
  modified_base (337)..(340): a, c, t, g, unknown or other
  modified_base (342)..(345): a, c, t, g, unknown or other
  modified_base (459)..(459): a, c, t, g, unknown or other
  modified_base (672)..(672): a, c, t, g, unknown or other
  modified_base (963)..(963): a, c, t, g, unknown or other
  modified_base (1053)..(1053): a, c, t, g, unknown or other
  modified_base (1101)..(1101): a, c, t, g, unknown or other
  modified_base (1110)..(1110): a, c, t, g, unknown or other
  modified_base (1131)..(1131): a, c, t, g, unknown or other
  modified_base (1227)..(1227): a, c, t, g, unknown or other
  modified_base (1298)..(1298): a, c, t, g, unknown or other
  modified_base (1335)..(1335): a, c, t, g, unknown or other
  modified_base (1506)..(1506): a, c, t, g, unknown or other
  modified_base (1675)..(1791): a, c, t, g, unknown or other
  modified_base (1815)..(1815): a, c, t, g, unknown or other
  modified_base (1839)..(1839): a, c, t, g, unknown or other
  modified_base (1854)..(1854): a, c, t, g, unknown or other
  modified_base (1933)..(1933): a, c, t, g, unknown or other
  modified_base (1941)..(1941): a, c, t, g, unknown or other
  modified_base (1956)..(1956): a, c, t, g, unknown or other
  modified_base (1962)..(1962): a, c, t, g, unknown or other
  modified_base (2069)..(2070): a, c, t, g, unknown or other
  modified_base (2072)..(2073): a, c, t, g, unknown or other
  modified_base (2180)..(2182): a, c, t, g, unknown or other
  modified_base (2184)..(2185): a, c, t, g, unknown or other
  modified_base (2187)..(2187): a, c, t, g, unknown or other
  modified_base (2189)..(2190): a, c, t, g, unknown or other
  modified_base (2491)..(2907): a, c, t, g, unknown or other
nnnnnnnnnnnnnnnnnnnnnnnnnnnnnnnnnnnnnnnnnnnnnnnnnnnnnnnnnnnnnnnnnnnnnacttactatcattcttcttcagttattccgcatgatgacccaactttgttgttcgccaatgccggcatgaaccaattcaaacccatcttccaagaaactgtggaccccaacagcgatttgggccgtttgaaacgagcagtgaacactcaaaagtgtattcgcgccggtggcaagcacaacgannnggacnnngtcggnnnggannncnancancacaccttcttngagatgntnggnaactggtcntttggngactatnnnaagnntnnnntnnnnacttgggcctgggaattcctcactcaatggctgcaaattccagccgatcgtctctatgtctcatattttggcggtgatgcggaagccggacttgatccggacgaggattgctgncaaatttggctcacccttggcgttcccgagtcccatttgctgccatttggcatgaaggacaacttctgggagatgggcgacactggcccctgtggtccttgctctgaaatccactatgatcgcattgggggtcgggatgcgtccaaactggtcaatgccgatgacccaatggtggtggagatttggaatcttgtgttcattcaatttaacagngaggagggcggtcaactcaaatctctgcccaacaagcacatcgattgtggccttggcttggaacgtcttgtggccgttgtccaacagaaaacatccaactacgacactgacctgttcacccccattttccgacaaatccatgaggagacaggagtgcgcgaatacaccggcaatgtgggccccaaagatgtggatggagtggacatggcctatcgggtggtcgcagaccacatccgaacattgactgtggcgcttagcgacggtggggtgccggattgcacgggaagaagntatgtgcttcgtcgaattctccgaagaggcgttcgatatgccaccgaaaaattgaacgcaaaacccggcttttttgcttcattagttccngttgttatcgacattttgggcaacacattccctgaattgcggaaaganccaacttcngtcattgacataatcaacgangaagaggcgcaatttttgaaaaccctccgccgcggccatgttcttttcgagaaggccgtaaaagcattgccacaaggcaccaagacattgccagtncaaattgcatggcgtctctacgacacctacggctttcccgtggacttgacccagttgatggcggaagagangggacttgctgtacagatggacgagtacgaggaatgncgcaaaaaggccattgaaatttcctcttccggcgctgccaaaatgcaagatgccctcaacttggacgtgcacacactggccgagctgcaaaagggaggcgttccaacaaccgatgactcgcccaaatatgtgtacggatacgatgggaagggatggcaagcggcatacatntttgaaaaatgcactggcaaaatccaacgcatccgagttggcaccgaatttgtggacaccattgaatcgggccaagaaggcgcactcctgctggatcggacctgcttttacgccgaacaaggtggccagatctacgacaccggcgtgctcaccaaaattggcgatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgttggctgatcatgaagaancacaccggaacgcatgtgctcaantacgcgctccaaaangtgctgaccacggtggaccagaagggctcgctggttgcgcccgaccgaatgcgctttgacttcacctccaaacaagcantgggcgtngagcaggtcaagcgngtggangaggcgggccagcagttgatcgacacccaggagaccgtctactcacaggagtgcgctcttgcaaaggcgaaggaaatcaaggggttgcgtgccgttttcgatgaggnntnncctgacccagtccgagttgttgccgtcggtgtgccggttgacaatcttctggaagatccgaacagcccactaggcttgaacacatccgtggaattttgtggaggaannnanntncnnaatgtttcgcacattggcaagctggtgatcaccaccgaggaggccattgccaagggcattcgccgaattgttgccgtcactgggcccgaggcggaaaaggcaatccacgctgcggaccgattggacagacggatggaagaattgttggaggaggcgaaaaaggaccaggaattggcggccagcacgggcgatgaggaggcaatcaagcagattggcaggaaaatcaccgaagaactcggcaccgcgcaattgccctattggcggagggacgcgctgcgcgagaaagtcaagcagctgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 682 - DNA, 1107 bp, Artificial Sequence
  Description of Artificial Sequence: Synthetic polynucleotide
  modified_base (1)..(3): a, c, t, g, unknown or other
  modified_base (33)..(33): a, c, t, g, unknown or other
  modified_base (84)..(84): a, c, t, g, unknown or other
  modified_base (96)..(96): a, c, t, g, unknown or other
  modified_base (99)..(100): a, c, t, g, unknown or other
  modified_base (117)..(117): a, c, t, g, unknown or other
  modified_base (195)..(195): a, c, t, g, unknown or other
  modified_base (198)..(198): a, c, t, g, unknown or other
  modified_base (222)..(222): a, c, t, g, unknown or other
  modified_base (270)..(270): a, c, t, g, unknown or other
  modified_base (288)..(288): a, c, t, g, unknown or other
  modified_base (337)..(337): a, c, t, g, unknown or other
  modified_base (342)..(342): a, c, t, g, unknown or other
  modified_base (348)..(348): a, c, t, g, unknown or other
  modified_base (354)..(354): a, c, t, g, unknown or other
  modified_base (366)..(366): a, c, t, g, unknown or other
  modified_base (417)..(417): a, c, t, g, unknown or other
  modified_base (420)..(420): a, c, t, g, unknown or other
  modified_base (423)..(423): a, c, t, g, unknown or other
  modified_base (426)..(426): a, c, t, g, unknown or other
  modified_base (732)..(732): a, c, t, g, unknown or other
  modified_base (741)..(741): a, c, t, g, unknown or other
  modified_base (754)..(754): a, c, t, g, unknown or other
  modified_base (784)..(784): a, c, t, g, unknown or other
  modified_base (837)..(837): a, c, t, g, unknown or other
  modified_base (840)..(840): a, c, t, g, unknown or other
  modified_base (858)..(858): a, c, t, g, unknown or other
  modified_base (996)..(996): a, c, t, g, unknown or other
  modified_base (1087)..(1107): a, c, t, g, unknown or other
nnnaataattctgcaccggtgccccattggganctcggcattggaccaatttcttgtcatgcttggaacaaggatagaacacanttagccgtttcnccnncaaacaatgaaattcanatatttgaaaaatctggcgcaacttggcgctcaatacacgtgttgaaggagcacgatttactcataaccggattggantgngcgccaaacacaaatcgtcttgtntcgtgttcacatgacaagaatgcgtttgtttggacttatgactctgcncaatggaaacccgaactngtgctggttcgaaccaaccgggccgcaacctgtgtgaaatggtcaccgntaganaacaanttcgcngttggcactggngctcgacttgtttctgtttgctattatgagcgtgaaaatgactggtggctntcnaancanatcaagaagccaatgcgttccacaatcacctcactggactggcaccccaacaatgtgctgcttgccattggtgcttgtgactttaaaacgcgtgttttctcggcctatgtcaaagagatcgacgaaaagccagcacccaatccatggggcaacaaaatgccttttggcgagctgctcaaggagtacacggacaatggttgggtgcacgatgtggccttctcaccgtcgggttgccgtttggcctgggtctcccacaactcggcaatttccgtggtggacaagtccaatccccagcaacaggaccanccaattacnacaccatttttgnctttcatcacggtgcgatgggtcaatgaangccacttgctgacagcgggctacgactgttccccaatgctttacacatttganggncacgcgataaagttggtntgcaaattggatgttccacccgaaagcaagggcgacacagtgaacagcgcctttgcaatgttccgcaattttgacaagaaagcggcagccgacaacacgagtgttcagctcaaaacactgcaccagaacacaattcancaattgaagatgcacacgggccagcaagggaacatgagcaaattctcgacctgtggctctgatgggattgtcgcactttgggatgttcagnnnnnnnnnnnnnnnnnnnnn

SEQ ID NO: 683 - DNA, 1029 bp, Artificial Sequence
  Description of Artificial Sequence: Synthetic polynucleotide
  modified_base (1)..(9): a, c, t, g, unknown or other
  modified_base (105)..(105): a, c, t, g, unknown or other
  modified_base (280)..(348): a, c, t, g, unknown or other
  modified_base (435)..(435): a, c, t, g, unknown or other
  modified_base (489)..(489): a, c, t, g, unknown or other
  modified_base (711)..(711): a, c, t, g, unknown or other
  modified_base (1021)..(1029): a, c, t, g, unknown or other
nnnnnnnnncaactggaaccgaccctcaagaatatcattgaccagaaaacactcaagtacatttttgtcggcggaaaaggcggagtgggcaaaacaacatgcagntgttctttggctgtccaattggcaaagcatcgtcgctcggtgctgatcatctccactgatccggcacacaacatctcggatgctttcaaccaaaaattttcgcgaactccgaccaaagtgaatggcttcgacaatttgttcgccatggaagtggacgcaacaacctttggcgagnnnnnnnnnnnnnnnnnnnnnnnnnnnnnnnnnnnnnnnnnnnnnnnnnnnnnnnnnnnnnnnnnnnnntggtccatgggcaagaacttcttggctgaattcgctggcggattgccgggcattgatgaggccaccagcttctcgcaaatgattaanctcgtccaatccatggactttgaagttgtccttttcgacacagcaccaacggtncacactcttcgtctccttcaattccctactgtcattgaaaagagtttgggccgctttctggccctcaagtcccaatttctgccaatgttctcgcaagtggctcccatgttggggctgaatgacgtttccatggactcggctgccaccaaactggaggaaactctccaaattgtgcgacaaatcaatgcggaattcaaagacccgaatctgacaacctttgtntgcatttgcattgccgagttcctgtccatgtacgagacggaacgccttgtgcaggagttgactcgacaggacatcgatgtgcacaacattgtggtcaaccaattgctgttccctgaccgcaaccctgacgggacaattgcatgcaaaaagtgcctttctcgtttcaacatccagcagaaatacttggagcagatcgccgaactctatgaggatttccacatcaccaaattgcctctgttggagaccgaagtccggggcccggagatgattgagcaattcagcaagcggctcatcaacccgccatcagatnnnnnnnnn

SEQ ID NO: 684 - DNA, 624 bp, Artificial Sequence
  Description of Artificial Sequence: Synthetic polynucleotide
  modified_base (1)..(9): a, c, t, g, unknown or other
  modified_base (208)..(309): a, c, t, g, unknown or other
  modified_base (330)..(337): a, c, t, g, unknown or other
  modified_base (477)..(480): a, c, t, g, unknown or other
  modified_base (603)..(603): a, c, t, g, unknown or other
  modified_base (609)..(609): a, c, t, g, unknown or other
  modified_base (618)..(618): a, c, t, g, unknown or other
  modified_base (622)..(624): a, c, t, g, unknown or other
nnnnnnnnnttgttcaaacgagcattctcactatcacgcgcccttcaacaagaacaagtcatcagacctcctgtacaagtctctggagtggaaggcaaatacgcttcggctctttattcatcaggagtgaaggagaaaagtctcgacaaattggagaaggatcttcaccaagtcaaggcgttgtatgacactaacaaggactttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgttttggccgaagggggnnnnnnnnacaaactgcccgggattgtctcctcattcgagaccattatgcgtgctcatcgaaatgaactccaggttgaagttaccagcgcagagccactcaataagaaacaagaacaggcactgaacgatgctctacagaaattcgcnnnnactggaaagaagctgaacatttcattcaccgtcaaaccatcaatgatcggcggtcttgtggtcactgttggcgacaaatacattgacatgtcggtggcatccaagctgaagaaaattgacacnctgatngaaaaggcnattnnn

SEQ ID NO: 685 - DNA, 1569 bp, Artificial Sequence
  Description of Artificial Sequence: Synthetic polynucleotide
  modified_base (1)..(3): a, c, t, g, unknown or other
  modified_base (198)..(198): a, c, t, g, unknown or other
  modified_base (411)..(411): a, c, t, g, unknown or other
  modified_base (612)..(612): a, c, t, g, unknown or other
  modified_base (636)..(636): a, c, t, g, unknown or other
  modified_base (663)..(663): a, c, t, g, unknown or other
  modified_base (840)..(840): a, c, t, g, unknown or other
  modified_base (966)..(966): a, c, t, g, unknown or other
  modified_base (1073)..(1075): a, c, t, g, unknown or other
  modified_base (1077)..(1077): a, c, t, g, unknown or other
  modified_base (1079)..(1079): a, c, t, g, unknown or other
  modified_base (1100)..(1100): a, c, t, g, unknown or other
  modified_base (1480)..(1569): a, c, t, g, unknown or other
nnngctgatcgctctttctcttcatccgaaccacttctgccagagaccatcaaattcatcaaagaaaatcttgagaaggcagtacacttcgaattgccacacgtgttcgttgtgtttggtgcctccggtgatttggccaaaaagaaaatatttcccactctttggtggctttttcgcgatggacttttgcccagagcnactcatattgtgggctacgcacgttccaaactgaatgtgcccaaagtgcgggaacaatttgagaagcactgcaaagtgcgtgaagaagaacgcgagaagttcgagaactacattcgccattgctcatatatttcgggtcaatacgacacagacgatggcttgattgctctgaatacggccattgccgagatggagtgcactttcaaaagtagnccggtcaatcggatattctatttggcactgccgcccgaagtgttccaaccagtcactgaacatatcaagcgccattgcatgagccaggataaggcctggactcgggtgatcattgaaaagcctttcggttatgacgatgtttcatctgccgaattgtctacccatctggcgcgtctgttcaccgaggatcaaatctatcgnattgaccactatctgggcaagganatggtccagaacatggtcgtgctcagnttcggcaacgaattcatttcgccctcttggagtcggcatcacgtggcctcggtgacaatcagcttcaaggaggattttggaacccaagggagaggcggctatttcgacaagagcgggataatccgggacataatgcaaaaccacctgatgcaaatactcacaattgtcgccatgganaagccagtcagtctgagcgcagaagacattcgcaataagaaggtggaagtgctgaaagtgatcaaacctgttccgctggaggatgtcgcactcggccagtacgtgggcaacccaaagggcgaagcngaggaatcacgcaaaggctatctggacgatccatcagttcccaaaggttcaatcactccaacttttgccaccgccgtcctttgggtgaacaacgagcgttggcaggnnntncntttctttttgcgttgtggaanagcattgaatgagcggaaagcggaggtgcgcatccaatacaaagacgtttccggggacattttccccaaagactcgctgaaacggaatgagctcgtcatccgagtgcaacccaatgaggcggtctatatgaaagtgaacaccaaacgcccgggtttctcgattgaatcggaacaaaccgaattggacttgaccttcaactcacgctacaaaggcattcgattccctgacgcctatgaacggctctttttcgacttgttcagtgggcgccaatacagctttgtgcgtgccgacgagttggagcaggcctggcggatattcacacccctgctcaagcgaatcgaaggcgagcgtatcaaaccagaagcatatgtctatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 686 - DNA, 1008 bp, Artificial Sequence
  Description of Artificial Sequence: Synthetic polynucleotide
  modified_base (1)..(36): a, c, t, g, unknown or other
  modified_base (355)..(405): a, c, t, g, unknown or other
  modified_base (982)..(1008): a, c, t, g, unknown or other
nnnnnnnnnnnnnnnnnnnnnnnnnnnnnnnnnnnngatgtggaagttcctaaaaacgcaccagacacatttcttctgcaaaagcataagcattacttgatcgcatgtggacgagaccgggattcatatgaatatgtaatggctgaatatttacgaatgagtggaatttattggtgtatggcagcacttgatcttaacgaaacaggagaggaatcagataaagaatttattgccgactttattcaacacaataaacgtgaagatggaggttacgcagcagcagaaggtcatgattcgcatttgttacacacattaagcgccgtacaactttcaataattataaacagagtagacnnnnnnnnnnnnnnnnnnnnnnnnnnnnnnnnnnnnnnnnnnnnnnnnnnntcaggtagtttctctggcgataaagctggtgagatagacacgcgtttctcattttgtgcaattgctacactgtacctacttgagcgtcttgatgcaattaatgttccaaagtcaatcgaatttatcaagcggtgttacaattttgatggtggttttggcacaaggcccggatccgaaagtcatgctggacaggtatattgttgcataggcgcattggcgatatgtggttgcttggaaataattgacgctgaaaggactactgaatggttggctgaacgacaatgcccttcaggtggattatgtggtcggcctgagaaattaccagatgtgtgttattcatggtgggtgcttgcttcactggcgatcctggaaagacttcactggattgacaaaaaatcattaactgaattcataattgggagccaagatgacgagaccggtggcatcgcagatcgtcctggtgacatgccagatcctttccatacagtatttggactttctggattgagcttgctgggttatgaaggtcttgaagccgtcgaccctgtgttttgtatgacaaagaaacgactcggcnnnnnnnnnnnnnnnnnnnnnnnnnnn

SEQ ID NO: 687 - DNA, 606 bp, Artificial Sequence
  Description of Artificial Sequence: Synthetic polynucleotide
  modified_base (1)..(114): a, c, t, g, unknown or other
  modified_base (258)..(258): a, c, t, g, unknown or other
  modified_base (604)..(606): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaattcatgcaattcacggctaaattggtcgcagaacggtcggcaacgcccagccgaagcagcatcaaggagggcgagtactttgtgcactgctatgtcagacacgacaatctggttggcgtatgcatgacagatgaggantaccaatcgcgagtggcgttcactttgctgaacaaggttttggccgactttgcagagcgggtgccttcccacgattgggctgcaattagaagtgagaatgattgcccatatgaccagttgccaatgttcctaacccgatggcagaatccgcgagaagcggacgcactcactcgcgtgcaggacgaagtggaggagaccaaggttgtgctgcacaacaccgtgcaagctgtgctggaacggggcgagaaaatggaggatttgatcaaggccagcgagaatttgtcggaccaaagcaaaatgttttacacgcaagcgcggaagatgaacaaatgctgtaactatgttnnn

SEQ ID NO: 688 - DNA, 939 bp, Artificial Sequence
  Description of Artificial Sequence: Synthetic polynucleotide
  modified_base (1)..(366): a, c, t, g, unknown or other
  modified_base (448)..(448): a, c, t, g, unknown or other
  modified_base (706)..(735): a, c, t, g, unknown or other
  modified_base (766)..(768): a, c, t, g, unknown or other
  modified_base (892)..(939): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcaagagcgcaaccgaaagcacgcgattggccgggtgcggattggcggcgagtgggagctgatcaatgtggatgggaagntggagggcaccaaggacttgctgggcaaatggctgctcatctacttcgggttcaccaactgccccgacgtttgcccggaagagattgagaagctgctggaagttgtggaaatcctgaaccgcgaggacgcctccatcccaatcctgcccattttcatctcggtcgaccccgagcgggacaccatcgagcgggtgcgcaagtactgctccgagttctcgcccaaacttcggggctacaccggcaacaaagagcaggttnnnnnnnnnnnnnnnnnnnnnnnnnnnnnncacagccagggcccgcgcacctccgcccagnnngatgactacattgtggaccacaccgtgatcatgtacttggtcgatccggaggggcaattccacgactactatgggcagaagcggcgggcggatgaaattgcgaatgtgatccgcagcaaggttnnnnnnnnnnnnnnnnnnnnnnnnnnnnnnnnnnnnnnnnnnnnnnnn

SEQ ID NO: 689 - DNA, 1266 bp, Artificial Sequence
  Description of Artificial Sequence: Synthetic polynucleotide
  modified_base (1)..(90): a, c, t, g, unknown or other
  modified_base (438)..(438): a, c, t, g, unknown or other
  modified_base (465)..(465): a, c, t, g, unknown or other
  modified_base (477)..(477): a, c, t, g, unknown or other
  modified_base (523)..(523): a, c, t, g, unknown or other
  modified_base (540)..(540): a, c, t, g, unknown or other
  modified_base (543)..(543): a, c, t, g, unknown or other
  modified_base (561)..(561): a, c, t, g, unknown or other
  modified_base (589)..(1266): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttgtgatgatgcggccgttgcaatcatcaatggggcaaggcaaattctctcggaccgcaggcattccgaccttggggcccatttccgctcccgcggcattgttccctacgcgtcggcaaggcatcacagagcattccttcctcgactgattaacgaagcgttggcggaaaaccgtttgcgtgcctcggacattgacgccgttgcggtgtccacccggccgggcattgtgatctgcttgaagacgggtgttgattgcgcactcagttttgccagggacttccgccgtcccctgatccccgtccatcacatgcgtgcccatgccctggtgatgcgtttgctggagccngggctggaattcccattctgcgcactnctcatttccggnggccattttctgatctgccttgtgcaaagcccatgggaatttcggntgttgtcccgggcaaancanggaagtccgggcgaatgnttggacaagctggcacggcaattggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 690 - DNA, 1101 bp, Artificial Sequence
  Description of Artificial Sequence: Synthetic polynucleotide
  modified_base (1)..(183): a, c, t, g, unknown or other
  modified_base (408)..(408): a, c, t, g, unknown or other
  modified_base (585)..(585): a, c, t, g, unknown or other
  modified_base (741)..(741): a, c, t, g, unknown or other
  modified_base (966)..(966): a, c, t, g, unknown or other
  modified_base (1093)..(1101): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtatatttccatgtgcgcggtgctccgttgattgctaccgttgggatgttgactcttttggttgatcaacaggcacaaagtcaggcttttgccgaagaacttgccaaagagtgcaagtatttgatgagtgcccgtccaacagccatcaatttgacgcatgctttcactgaactgcttgcgcatgttgagcagcaaattgggcaggggattgtcgaaatgaanagtgtgcgcaactttgtgctggaatggcaagcgcgtgaaagacaggagaacgaccttttgctgcgcaactccattgtcggagtgctgggcgcagtcaagggcaagtcgaaactggtggccatgaccatttgcaacacgggccagttggccacctcctcttttggcacggcacttgcngtgatcctgatgctgcaccgacttggccacttggattatgccctcgtgttcgaaacgcgcccgtacaaccagggatcacgattgaccagctatgagctgcaacagggaggcgtgccattcaagctgattccggacagtgcggtcagttggggcgantaaaaccgcggattttcaatgagctttgaaggcgctgaccaagtgtcactgaacggggacacggccaacaaaattggcacctattcgctggccatcaatgctaaggcgcacggcatccccttctttgtggtcaccccaattgcatcggtgaattcccggctggcagatggtcggggcattcgggtggaagaacggccggcccaggaattgacccattggaatgcnatttcccattgccccgctgagtgccctgtgtggaacccggcatttgacgttaccccgggcaaacttgtctccggctttctgacggaacgcggaaacttcacgtccgcccaacttgcccaggccctcnnnnnnnnn

SEQ ID NO: 691 - DNA, 1059 bp, Artificial Sequence
  Description of Artificial Sequence: Synthetic polynucleotide
  modified_base (1)..(33): a, c, t, g, unknown or other
  modified_base (67)..(67): a, c, t, g, unknown or other
  modified_base (69)..(69): a, c, t, g, unknown or other
  modified_base (73)..(73): a, c, t, g, unknown or other
  modified_base (78)..(78): a, c, t, g, unknown or other
  modified_base (87)..(87): a, c, t, g, unknown or other
  modified_base (158)..(158): a, c, t, g, unknown or other
  modified_base (166)..(166): a, c, t, g, unknown or other
  modified_base (169)..(169): a, c, t, g, unknown or other
  modified_base (173)..(173): a, c, t, g, unknown or other
  modified_base (177)..(178): a, c, t, g, unknown or other
  modified_base (450)..(450): a, c, t, g, unknown or other
  modified_base (534)..(535): a, c, t, g, unknown or other
  modified_base (564)..(564): a, c, t, g, unknown or other
  modified_base (576)..(576): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (598)..(599): a, c, t, g, unknown or other
  modified_base (601)..(601): a, c, t, g, unknown or other
  modified_base (603)..(603): a, c, t, g, unknown or other
  modified_base (606)..(606): a, c, t, g, unknown or other
  modified_base (612)..(613): a, c, t, g, unknown or other
  modified_base (616)..(619): a, c, t, g, unknown or other
  modified_base (621)..(621): a, c, t, g, unknown or other
  modified_base (627)..(628): a, c, t, g, unknown or other
  modified_base (630)..(631): a, c, t, g, unknown or other
  modified_base (633)..(636): a, c, t, g, unknown or other
  modified_base (639)..(639): a, c, t, g, unknown or other
  modified_base (648)..(648): a, c, t, g, unknown or other
  modified_base (655)..(655): a, c, t, g, unknown or other
  modified_base (657)..(657): a, c, t, g, unknown or other
  modified_base (660)..(661): a, c, t, g, unknown or other
  modified_base (663)..(663): a, c, t, g, unknown or other
  modified_base (666)..(666): a, c, t, g, unknown or other
  modified_base (668)..(669): a, c, t, g, unknown or other
  modified_base (671)..(675): a, c, t, g, unknown or other
  modified_base (680)..(680): a, c, t, g, unknown or other
  modified_base (682)..(682): a, c, t, g, unknown or other
  modified_base (684)..(685): a, c, t, g, unknown or other
  modified_base (690)..(690): a, c, t, g, unknown or other
  modified_base (696)..(696): a, c, t, g, unknown or other
  modified_base (699)..(699): a, c, t, g, unknown or other
  modified_base (705)..(705): a, c, t, g, unknown or other
  modified_base (708)..(708): a, c, t, g, unknown or other
  modified_base (714)..(715): a, c, t, g, unknown or other
  modified_base (717)..(717): a, c, t, g, unknown or other
  modified_base (719)..(719): a, c, t, g, unknown or other
  modified_base (722)..(722): a, c, t, g, unknown or other
  modified_base (727)..(727): a, c, t, g, unknown or other
  modified_base (729)..(729): a, c, t, g, unknown or other
  modified_base (738)..(739): a, c, t, g, unknown or other
  modified_base (741)..(742): a, c, t, g, unknown or other
  modified_base (744)..(747): a, c, t, g, unknown or other
  modified_base (749)..(749): a, c, t, g, unknown or other
  modified_base (751)..(753): a, c, t, g, unknown or other
  modified_base (757)..(757): a, c, t, g, unknown or other
  modified_base (759)..(762): a, c, t, g, unknown or other
  modified_base (858)..(858): a, c, t, g, unknown or other
  modified_base (882)..(882): a, c, t, g, unknown or other
  modified_base (1054)..(1059): a, c, t, g, unknown or other
nnnnnnnnnnnnnnnnnnnnnnnnnnnnnnnnnagccgacaattcagcagaacctcccaacttggcncntcantgaangttcgggangccctcaaccaggccatggacgaggagttggaaagggatgaccgcgttttcttgctgggcgaagaagttgnccaaatanaangccntttnnaggtgagcaaaggcctgtggaagaagtacggcgaccagcgcattgtggacaccccgatcacggagatgggctttactggactggcagtgggcgccgccttcgccggactcaggcccatctgcgagttcatgaccttcaacttcgccatgcaagccatcgaccagatcatcaacagtgcgggcaaaaccttctacatgtccgccggcagggttcccgtcccaattgtcttccgtggccccaatggcgcggcagccggcgtggccgcacaaccnagtcaagactatggcgcctggtacgcgcattgtccgggcctgaaggtgttggcgccgtacaattcggaggatgcaaaaggtttnntgaaagcggccatccgtgacgacaatccngtggttttcctnganaanganctnctctacggcnncncnttnccggtnnccnnnnangtgctnnanncnnnnttngtgctgccnattggcnangcnnangtngnncnnnnnggcgncnanntcacnattgtntcntactcnaanggcgtnnancnttncctgnangcagccgannanntnnnngngnnnggcntnnnngcggaggtgatcaatttgcgcactctgcgccccctcgacttcgacaccatcgccgactctgtgcgcaaaaccaaccatttggtcacggtggaaacnggctggcccttctgcggcattggngccgaactgtccgcgcaagtggccgaatccgatgtgtttgaccacctggatgcgcccgtgctcagagttacaggtttggacattccaatgccctacacggcaacgctggaggccgccgcactgccaaccaccggggacgtggtcaggaccgtcaagaagagtctgcacatcnnnnnn

SEQ ID NO: 692 - DNA, 378 bp, Artificial Sequence
  Description of Artificial Sequence: Synthetic polynucleotide
  modified_base (1)..(258): a, c, t, g, unknown or other
  modified_base (264)..(264): a, c, t, g, unknown or other
  modified_base (279)..(279): a, c, t, g, unknown or other
  modified_base (282)..(282): a, c, t, g, unknown or other
  modified_base (286)..(286): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (358)..(378): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattcnctgctggtcggctangangtgntcgagggcgagcttgagtgccccgaaacncanagagtcttcccnatcaccgagggcatcccgaacatgctgnnnnnnnnnnnnnnnnnnnnn

SEQ ID NO: 693 - DNA, 1113 bp, Artificial Sequence
  Description of Artificial Sequence: Synthetic polynucleotide
  modified_base (1)..(135): a, c, t, g, unknown or other
  modified_base (154)..(154): a, c, t, g, unknown or other
  modified_base (574)..(618): a, c, t, g, unknown or other
  modified_base (720)..(720): a, c, t, g, unknown or other
  modified_base (958)..(1113): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatcagcacttttgganccgacgacaacccacatggcatggtttgcgagtcctcattcgccacactcttccctaaatatcgcgagaaatacattcgtgaggtttggccgttagtgcagaaagcattggcagagcatcatgtcaagggcgatttagatgtgcttgaagttacaatgacagtacgaaccacacgcaagacttgggatccctttattctctacaaggccagggacttgatcaaattgcttgccaggagtgtgccctttgaacatgctcggcgcgtgttggaagatcaaatcttttgtgacattatcaaaattgcttcaatggtgccgaatcgggaacgttttgtgaagcgccgtgcacgtttggtgggccagaatggtgcaactctgaaggcgatagagttgctaaccgaatgctacgttcaaatacagnnnnnnnnnnnnnnnnnnnnnnnnnnnnnnnnnnnnnnnnnnnnnttcaggaaaatagttgaggattgcatgcacaacattcacccaatttacaacataaagaccctgatgatcaaacgcgagctgatgaaggacgagaagctgcgnaacgaaaactgggaccgtttcctgccaaaattcaagaagaaggtgcaaagtgccaaggaggtgcgcgagctgaagaaaaaggcaaaagccaaatggaagccaaagaaggaatacacgccgttcccgccgccccagcagcctcggaaggttgacttgcagatggagagtggcgaattcttcctcaacaataacaacaagcaaacgaggcatcagaagaaacaggccgaagctgaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 694 - DNA, 444 bp, Artificial Sequence
  Description of Artificial Sequence: Synthetic polynucleotide
  modified_base (433)..(444): a, c, t, g, unknown or other
atgtcgttggcaaccaaactgcgtcggatgcgtaaaaagccgccagagggctgggacttgattgagccaacattggaagagttcgaggcaaaaatgcgcgaggctgagaccgagccacatgaggggaaaagacgcacagaaacggtttggcccgtctttagaatccaccaccaacgcactcgctacatcttcaacctgtactacaaggaggagaagatctcgcgggagctctaccaattctgtgtggacgcaaagctggtggacgcccagttggcggcaaagtggaagaaaccgggcttcgagaacctctgctgcctgcgatgcatacagagcagagacaccaactttggcacgaactgcatttgccgggtgcccaagtccaagatggatgcgggccgagtcattgagtgtgtccattgcggctgccgtggtnnnnnnnnnnnn

SEQ ID NO: 695 - DNA, 1512 bp, Artificial Sequence
  Description of Artificial Sequence: Synthetic polynucleotide
  modified_base (1)..(204): a, c, t, g, unknown or other
  modified_base (220)..(220): a, c, t, g, unknown or other
  modified_base (234)..(234): a, c, t, g, unknown or other
  modified_base (243)..(243): a, c, t, g, unknown or other
  modified_base (246)..(246): a, c, t, g, unknown or other
  modified_base (273)..(273): a, c, t, g, unknown or other
  modified_base (298)..(298): a, c, t, g, unknown or other
  modified_base (300)..(300): a, c, t, g, unknown or other
  modified_base (304)..(1512): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggctccaagcaanccccaatgtttggngatttcgangcncaacggcactggatggaactgaccgtnaatttgcccattgaacaatggtttntnagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 696 - DNA, 1128 bp, Artificial Sequence
  Description of Artificial Sequence: Synthetic polynucleotide
  modified_base (1)..(12): a, c, t, g, unknown or other
  modified_base (111)..(111): a, c, t, g, unknown or other
  modified_base (295)..(489): a, c, t, g, unknown or other
  modified_base (618)..(618): a, c, t, g, unknown or other
  modified_base (649)..(684): a, c, t, g, unknown or other
  modified_base (690)..(690): a, c, t, g, unknown or other
  modified_base (720)..(720): a, c, t, g, unknown or other
  modified_base (748)..(748): a, c, t, g, unknown or other
  modified_base (759)..(759): a, c, t, g, unknown or other
  modified_base (802)..(802): a, c, t, g, unknown or other
  modified_base (805)..(806): a, c, t, g, unknown or other
  modified_base (808)..(808): a, c, t, g, unknown or other
  modified_base (812)..(813): a, c, t, g, unknown or other
  modified_base (825)..(825): a, c, t, g, unknown or other
  modified_base (843)..(843): a, c, t, g, unknown or other
  modified_base (855)..(855): a, c, t, g, unknown or other
  modified_base (930)..(930): a, c, t, g, unknown or other
  modified_base (940)..(1128): a, c, t, g, unknown or other
nnnnnnnnnnnntcgggccttacttgcttaacttgccgtttggtcttttccgacggggaggtacagaggcaacattatgcgagtgaatatcacctttacaatgtgaaaggnaatgaatttgaattgaagttgcaacaattatcacaggttttaaaatttcaatatttattttttatttttaagaacaaatcaaacactgcttcaaatgatctttattgctccaattgcagtaaaaaattccaatcaattatggcttatgaaaatcattgtaaatcgaaaaaacacaaggaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttgttttgctcatctttattcaagaaaatggaaacatcattggagcacatgtcaaatgcgcacggattttacattcccgacttccaatattgttctgatttacccggattgcttgaatatcttgtntggaaagttggtgcagggaaaacatgcttgnnnnnnnnnnnnnnnnnnnnnnnnnnnnnnnnnnnncagtcngtgcaaaagcatatgcgcgacaaaaaccantgtaatttccggatcgatgaagaatgtntattggaattnatggatttctacgattataacgagatgtacgagaatgaagatncanngnaaanngtgctttatgangatggttcgttcttgacnctgccatcaggngcaaagattggacatcgcttgttgttccgatatttcaagcaatctttgaaaccaatccgggatgaacagaatatnctaaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 697 - DNA, 789 bp, Artificial Sequence
  Description of Artificial Sequence: Synthetic polynucleotide
  modified_base (1)..(66): a, c, t, g, unknown or other
  modified_base (226)..(582): a, c, t, g, unknown or other
  modified_base (787)..(789): a, c, t, g, unknown or other
nnnnnnnnnnnnnnnnnnnnnnnnnnnnnnnnnnnnnnnnnnnnnnnnnnnnnnnnnnnnnnnnnnccaggcattgacaaaatccatggccatcttgagaagaagaaggattggattcggagaacgcgcgactatcgggaaaaggcggacaagatcaagcagttgaagaggaaagcgaaggagaagaatccggatgagtttgccttccacatgttacgcagccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacggaaaaagagcggcagcgactttacgccgagttggggaagcggatggagcgcgagcaggagttggccgttgtgctgcgcaaactggaactgaagaaggatttggccctgtcgaagaagtccgaactgaagcccaagctaatccaaaagggcaatgccgagagagcggccgtctacaagtggacctacgagaggaagaaannn

SEQ ID NO: 698 - DNA, 2112 bp, Artificial Sequence
  Description of Artificial Sequence: Synthetic polynucleotide
  modified_base (1)..(87): a, c, t, g, unknown or other
  modified_base (123)..(123): a, c, t, g, unknown or other
  modified_base (126)..(126): a, c, t, g, unknown or other
  modified_base (334)..(334): a, c, t, g, unknown or other
  modified_base (336)..(337): a, c, t, g, unknown or other
  modified_base (339)..(340): a, c, t, g, unknown or other
  modified_base (343)..(343): a, c, t, g, unknown or other
  modified_base (345)..(345): a, c, t, g, unknown or other
  modified_base (838)..(1032): a, c, t, g, unknown or other
  modified_base (1176)..(1176): a, c, t, g, unknown or other
  modified_base (1206)..(1206): a, c, t, g, unknown or other
  modified_base (1215)..(1215): a, c, t, g, unknown or other
  modified_base (1239)..(1239): a, c, t, g, unknown or other
  modified_base (1257)..(1257): a, c, t, g, unknown or other
  modified_base (1283)..(1283): a, c, t, g, unknown or other
  modified_base (1293)..(1295): a, c, t, g, unknown or other
  modified_base (1302)..(1302): a, c, t, g, unknown or other
  modified_base (1306)..(1306): a, c, t, g, unknown or other
  modified_base (1326)..(1326): a, c, t, g, unknown or other
  modified_base (1344)..(1344): a, c, t, g, unknown or other
  modified_base (1350)..(1350): a, c, t, g, unknown or other
  modified_base (1387)..(1410): a, c, t, g, unknown or other
  modified_base (1533)..(1533): a, c, t, g, unknown or other
  modified_base (1605)..(1605): a, c, t, g, unknown or other
  modified_base (1710)..(1710): a, c, t, g, unknown or other
  modified_base (1825)..(1825): a, c, t, g, unknown or other
  modified_base (1833)..(1833): a, c, t, g, unknown or other
  modified_base (1891)..(1891): a, c, t, g, unknown or other
  modified_base (1908)..(1908): a, c, t, g, unknown or other
  modified_base (1982)..(1982): a, c, t, g, unknown or other
  modified_base (1985)..(1995): a, c, t, g, unknown or other
  modified_base (1997)..(1998): a, c, t, g, unknown or other
  modified_base (2000)..(2003): a, c, t, g, unknown or other
  modified_base (2038)..(2040): a, c, t, g, unknown or other
  modified_base (2098)..(2112): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnattcaagcatgtcgtgaagcatttgccaaaggcgcncgncttcgcctcggaccagaactggaaattcccggctactcatgtttggaccacttttatgagcccgacacggaaactcattcctgggaagttttgcgtgaaattgtggaggaatcgaatcagatgcccaaccttctgatcataaccggaatgccaattcgccacaaactgggcctttacaactgcaatgtggcactcgccaatggacagntnntnnttntntacccaaaaaccgtactagccaatgacgacatctaccgagagggcagatggtttgttccatggcaacacaagtggaatgtgatcgacttcaagttggacaagaaatatggcttcaatcaagaatcagtgccattcggcaatgcctacatcgagtccggggatcaagtcaaaattggctttgaaatgtgcgaggaaatgtggaccgccacttcgccgagcaatgagcttgctttgcagggagttgagatcatttgcaactcgagtggaagccatcacgtgctgggcaaatccaacactcggatcaatcagttggtgcttgggacgacttcaaaacttggcggcgtctatttgtacgcaaaccatcggggaatggacggggagcgcatttacttcgatgggatgagctcgattgcccagaacagcaagctttacgctcagattgcacagtttgacattgaggacacttgcacggtgaattgtgtgctgaacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttggctttggaattacctgcgtcgtagcaaacagaacggattctttttgccattgtccggaggccaggacagcagttcggtggcgttgatggttcgcctgatgtgcgagaaggtcgcacaagcagtgcgcgacaatccaatntatttagattccgacgatccagcctatttnctgggcggngaacgggtcacaacggatccggcngaactgtgcaagagtctnctcttcacttgctacatgggctcaancaactcgtcnnnaatgacncgcncattggctgccgggttggcngcggacatcaacgcaacncattcnactattgtgattgactcaattgttgagtctttccttnnnnnnnnnnnnnnnnnnnnnnnntttaattaagaattttagtctgacgacaaacgcgagggaatggccctccaaaatgtgcaagctcgtacccgaatggtgttggcctacttgcatgctcaaaccgcgcttatcaaggctgcaaancctggaaatttgcttgttcttggcacttcgaatgttgacgagagtctggttggctatgtcaccaaatatgtntgttcctcagccgatttgaatccgattggggccgtctcaaagcatgatctccgtgaatttttgcgttatgtgaatggaacccataaattcaaacattgcaaacgnattattgaatcgactcccaccgccgaattgagccccttgatgaatggggaagttgttcaaactgacgaagcggaaattggactcacctacgaagagctttccacttttgggcganttcgccgncccggatgctctggcccgatgggaatgtttatggaactgattcatgaatggcatccgncaatcagctatcagganattgcccgcaaagtggagcatttcttccgccgctatgccaacaatcgtcacaaggcgaccatcgcaactccggnttnnnnnnnnnnnanntnnnncaacgatgaccatcggaacgaccatcggcccttcnnntacccggattttgagcatcaattccagagaatccaccaaatggtcaaggaattggagnnnnnnnnnnnnnnn

SEQ ID NO: 699 - DNA, 1905 bp, Artificial Sequence
  Description of Artificial Sequence: Synthetic polynucleotide
  modified_base (1)..(303): a, c, t, g, unknown or other
  modified_base (459)..(459): a, c, t, g, unknown or other
  modified_base (461)..(462): a, c, t, g, unknown or other
  modified_base (465)..(465): a, c, t, g, unknown or other
  modified_base (467)..(472): a, c, t, g, unknown or other
  modified_base (476)..(477): a, c, t, g, unknown or other
  modified_base (531)..(531): a, c, t, g, unknown or other
  modified_base (559)..(559): a, c, t, g, unknown or other
  modified_base (567)..(567): a, c, t, g, unknown or other
  modified_base (585)..(585): a, c, t, g, unknown or other
  modified_base (600)..(600): a, c, t, g, unknown or other
  modified_base (623)..(623): a, c, t, g, unknown or other
  modified_base (669)..(669): a, c, t, g, unknown or other
  modified_base (687)..(687): a, c, t, g, unknown or other
  modified_base (693)..(693): a, c, t, g, unknown or other
  modified_base (695)..(695): a, c, t, g, unknown or other
  modified_base (753)..(753): a, c, t, g, unknown or other
  modified_base (775)..(775): a, c, t, g, unknown or other
  modified_base (777)..(777): a, c, t, g, unknown or other
  modified_base (801)..(801): a, c, t, g, unknown or other
  modified_base (816)..(816): a, c, t, g, unknown or other
  modified_base (882)..(882): a, c, t, g, unknown or other
  modified_base (889)..(889): a, c, t, g, unknown or other
  modified_base (895)..(895): a, c, t, g, unknown or other
  modified_base (924)..(924): a, c, t, g, unknown or other
  modified_base (966)..(966): a, c, t, g, unknown or other
  modified_base (999)..(999): a, c, t, g, unknown or other
  modified_base (1053)..(1054): a, c, t, g, unknown or other
  modified_base (1056)..(1056): a, c, t, g, unknown or other
  modified_base (1069)..(1069): a, c, t, g, unknown or other
  modified_base (1101)..(1101): a, c, t, g, unknown or other
  modified_base (1170)..(1170): a, c, t, g, unknown or other
  modified_base (1198)..(1200): a, c, t, g, unknown or other
  modified_base (1203)..(1208): a, c, t, g, unknown or other
  modified_base (1210)..(1210): a, c, t, g, unknown or other
  modified_base (1212)..(1213): a, c, t, g, unknown or other
  modified_base (1215)..(1216): a, c, t, g, unknown or other
  modified_base (1218)..(1218): a, c, t, g, unknown or other
  modified_base (1223)..(1223): a, c, t, g, unknown or other
  modified_base (1225)..(1226): a, c, t, g, unknown or other
  modified_base (1228)..(1228): a, c, t, g, unknown or other
  modified_base (1230)..(1231): a, c, t, g, unknown or other
  modified_base (1233)..(1234): a, c, t, g, unknown or other
  modified_base (1240)..(1240): a, c, t, g, unknown or other
  modified_base (1246)..(1246): a, c, t, g, unknown or other
  modified_base (1248)..(1249): a, c, t, g, unknown or other
  modified_base (1251)..(1251): a, c, t, g, unknown or other
  modified_base (1254)..(1260): a, c, t, g, unknown or other
  modified_base (1264)..(1264): a, c, t, g, unknown or other
  modified_base (1266)..(1266): a, c, t, g, unknown or other
  modified_base (1296)..(1296): a, c, t, g, unknown or other
  modified_base (1317)..(1317): a, c, t, g, unknown or other
  modified_base (1332)..(1332): a, c, t, g, unknown or other
  modified_base (1335)..(1335): a, c, t, g, unknown or other
  modified_base (1356)..(1356): a, c, t, g, unknown or other
  modified_base (1374)..(1374): a, c, t, g, unknown or other
  modified_base (1386)..(1386): a, c, t, g, unknown or other
  modified_base (1395)..(1395): a, c, t, g, unknown or other
  modified_base (1401)..(1401): a, c, t, g, unknown or other
  modified_base (1453)..(1453): a, c, t, g, unknown or other
  modified_base (1467)..(1467): a, c, t, g, unknown or other
  modified_base (1488)..(1488): a, c, t, g, unknown or other
  modified_base (1492)..(1492): a, c, t, g, unknown or other
  modified_base (1494)..(1494): a, c, t, g, unknown or other
  modified_base (1515)..(1515): a, c, t, g, unknown or other
  modified_base (1524)..(1525): a, c, t, g, unknown or other
  modified_base (1533)..(1533): a, c, t, g, unknown or other
  modified_base (1623)..(1623): a, c, t, g, unknown or other
  modified_base (1629)..(1629): a, c, t, g, unknown or other
  modified_base (1641)..(1641): a, c, t, g, unknown or other
  modified_base (1653)..(1653): a, c, t, g, unknown or other
  modified_base (1764)..(1764): a, c, t, g, unknown or other
  modified_base (1795)..(1905): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcaattgccgagatgggctgggaacggccaacgcccgtgcaggccgcgatgatcccattggcattggatgagaagaacattttggccagagcgcgaacaggcagtgggaaaacggccgcttttcttttgccgatgattcagaaaatgctcctncnntcnannnnnnaaannaccaatagagggcctttagcgctgatcatcgcaccaacaaaggagctggcttcncaaatttttacacaattggagcaattgnccacttcntttcccttcatccaaagnctcaatttggctcantttgcggacacccatgatcagangcttgggcaagagatgatcgacattttggtgggcacgcccggtcgngtgttggcggccacttcnaaaacntntcaactgttggaaagagtgcaatgtgtggttctggatgaggccgatctgctcttctcntatggctatcaacaggaaatgnanaaattgaaggcgcttttgcccacncgcttccaaaccatnatgacatcggcaacactcaacgaggacttgagtgaattgaagaagaatttcattgttggcaaagtncattcantgaaantgaaggaaggagatttgccgggtatggancaattggaacagtttcacatttcttgccaaaatgaagaagancgtttcacaattctacttgcattgatcaagctnaaattgttggtgggcaaatcggttgttttcgtgtcaaccgttgaccgatgctannancttcatctgtttntgcaagcattcaaagtgccgtcttgcgtgctnaacgctgaaatgccggctaattcccgttgccgaatcatccatgagttcaatcaaggtcgatggccattnctgattgcttccgaatgcaatgacattnnngannnnnncnannannangatgntnncnannannatgatnataagnanngnaannnnnnnaaananaagaacaaaaagcgtgaacttgacaaagantctggcattggtcgtggcatngacttccattctgtnccnaacgtgatcaattttgatttncccctctccgcggacatntacgtgcacagngttggcagnactgcncgcggtttcaacaaaggcaccgcaatatcatttgcttcgcaggatgagaggncacttttcgaacanattcaaaccgaaattaatganagangnggtcaaccagtgttacgcccntatgaagtnngaatgaangattttgagggttttttgttgcgtgcgagggatgttctggctgcctgtactcgtacaattttcattcagacgcgaatggccgagatcagngagganttgctgcactcnagaagactggangcatattttgccaaaaatcctcgtgagcgcatggcattggagcaggatagaaagcaattcaaattgaatgtgcacagtgccggaatcgctgacgtccccgattatatgggnccaaaagcgctgagaggccaaaatttctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 700 - DNA, 195 bp, Artificial Sequence
  Description of Artificial Sequence: Synthetic polynucleotide
  modified_base (1)..(48): a, c, t, g, unknown or other
  modified_base (178)..(195): a, c, t, g, unknown or other
nnnnnnnnnnnnnnnnnnnnnnnnnnnnnnnnnnnnnnnnnnnnnnnnttccagaagcaagaccccgaaggccacaacacattctcggcccatccggcacgcttctcgcccgaggacaagtactccaagtaccggctgatcgtgaagaaacgctttgggttgttgcccacccagcagnnnnnnnnnnnnnnnnnn

SEQ ID NO: 701 - DNA, 852 bp, Artificial Sequence
  Description of Artificial Sequence: Synthetic polynucleotide
  modified_base (1)..(228): a, c, t, g, unknown or other
  modified_base (463)..(465): a, c, t, g, unknown or other
  modified_base (556)..(852): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttcatatcatttcatccaattcatcccgtccattcagacattgcccgtgaccataacgagaccgacggcgaactacttcaggcggacatgggcgccggcctgcccttccgtgcggccaccttcgacggggccatcagcgtgtccgccgtccagtggctttgccattccaactccaagcgggaggatccccggcggcggctgctctcttctttgagtccctctttgcctgctnnntgacgctcggcacgggccgtcttccagttctacccggagagccaacagcagtgcgagctgatcagccagcaggcactgcgggcgggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 702 - DNA, 1023 bp, Artificial Sequence
  Description of Artificial Sequence: Synthetic polynucleotide
  modified_base (1)..(12): a, c, t, g, unknown or other
  modified_base (70)..(70): a, c, t, g, unknown or other
  modified_base (96)..(97): a, c, t, g, unknown or other
  modified_base (120)..(120): a, c, t, g, unknown or other
  modified_base (135)..(135): a, c, t, g, unknown or other
  modified_base (141)..(141): a, c, t, g, unknown or other
  modified_base (182)..(189): a, c, t, g, unknown or other
  modified_base (205)..(243): a, c, t, g, unknown or other
  modified_base (316)..(339): a, c, t, g, unknown or other
  modified_base (436)..(633): a, c, t, g, unknown or other
  modified_base (760)..(762): a, c, t, g, unknown or other
  modified_base (826)..(1023): a, c, t, g, unknown or other
nnnnnnnnnnnnattggcacgcacgacgggaaattccactgcgatgaggtttttgcctgctacatgctcnaaaagctgcccgagtttgctggccanncggttgtgcgcacacgggaagcngagacactggccaantgcgangtggttgtggacgtgggcggcgtttatgatcacgccaaaannnnnnnngatcatcaccagaggnnnnnnnnnnnnnnnnnnnnnnnnnnnnnnnnnnnnnnntttccagacaaattgagctcggctggccttatctacgcgcactacggacgcgaggtcataagacaaattctannnnnnnnnnnnnnnnnnnnnnnngtggacaaactctacgatcggctctacaagaattttgtggaatcaatcgatgcaatcgacaatggcatccagcaattcgaagggccatcaaggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcacgaaagtgggaagattttgaccttccctccaggcaattgcccttggaaagagcacttcttcgcgctggaaaaggagctgggacttgccaacgagggaatttgcttggccgtcttccaggatnnngtgggtggcaattggcgagtgcaggcaatcccagtctcgggggagagtggatttgaaaatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 703 - DNA, 2916 bp, Artificial Sequence
  Description of Artificial Sequence: Synthetic polynucleotide
  modified_base (1)..(240): a, c, t, g, unknown or other
  modified_base (346)..(363): a, c, t, g, unknown or other
  modified_base (417)..(417): a, c, t, g, unknown or other
  modified_base (631)..(817): a, c, t, g, unknown or other
  modified_base (903)..(903): a, c, t, g, unknown or other
  modified_base (909)..(909): a, c, t, g, unknown or other
  modified_base (913)..(913): a, c, t, g, unknown or other
  modified_base (921)..(921): a, c, t, g, unknown or other
  modified_base (930)..(930): a, c, t, g, unknown or other
  modified_base (957)..(957): a, c, t, g, unknown or other
  modified_base (996)..(996): a, c, t, g, unknown or other
  modified_base (1034)..(1035): a, c, t, g, unknown or other
  modified_base (1204)..(1206): a, c, t, g, unknown or other
  modified_base (1344)..(1344): a, c, t, g, unknown or other
  modified_base (1569)..(1574): a, c, t, g, unknown or other
  modified_base (1576)..(1580): a, c, t, g, unknown or other
  modified_base (1582)..(1584): a, c, t, g, unknown or other
  modified_base (1587)..(1589): a, c, t, g, unknown or other
  modified_base (1591)..(1592): a, c, t, g, unknown or other
  modified_base (1611)..(1611): a, c, t, g, unknown or other
  modified_base (1624)..(1626): a, c, t, g, unknown or other
  modified_base (1632)..(1632): a, c, t, g, unknown or other
  modified_base (1635)..(1638): a, c, t, g, unknown or other
  modified_base (1651)..(1651): a, c, t, g, unknown or other
  modified_base (1653)..(1653): a, c, t, g, unknown or other
  modified_base (1658)..(1658): a, c, t, g, unknown or other
  modified_base (1662)..(1663): a, c, t, g, unknown or other
  modified_base (1666)..(1666): a, c, t, g, unknown or other
  modified_base (1668)..(1668): a, c, t, g, unknown or other
  modified_base (1681)..(1681): a, c, t, g, unknown or other
  modified_base (1684)..(1684): a, c, t, g, unknown or other
  modified_base (1686)..(1686): a, c, t, g, unknown or other
  modified_base (1690)..(1690): a, c, t, g, unknown or other
  modified_base (1696)..(1696): a, c, t, g, unknown or other
  modified_base (1703)..(1704): a, c, t, g, unknown or other
  modified_base (1710)..(1710): a, c, t, g, unknown or other
  modified_base (1723)..(1723): a, c, t, g, unknown or other
  modified_base (1726)..(1726): a, c, t, g, unknown or other
  modified_base (1750)..(1750): a, c, t, g, unknown or other
  modified_base (1755)..(1759): a, c, t, g, unknown or other
  modified_base (1773)..(1773): a, c, t, g, unknown or other
  modified_base (1827)..(1827): a, c, t, g, unknown or other
  modified_base (1836)..(1836): a, c, t, g, unknown or other
  modified_base (1845)..(1845): a, c, t, g, unknown or other
  modified_base (1869)..(1869): a, c, t, g, unknown or other
  modified_base (1872)..(1872): a, c, t, g, unknown or other
  modified_base (1878)..(1878): a, c, t, g, unknown or other
  modified_base (1881)..(1881): a, c, t, g, unknown or other
  modified_base (2016)..(2016): a, c, t, g, unknown or other
  modified_base (2034)..(2034): a, c, t, g, unknown or other
  modified_base (2038)..(2038): a, c, t, g, unknown or other
  modified_base (2040)..(2040): a, c, t, g, unknown or other
  modified_base (2082)..(2082): a, c, t, g, unknown or other
  modified_base (2131)..(2301): a, c, t, g, unknown or other
  modified_base (2398)..(2460): a, c, t, g, unknown or other
  modified_base (2631)..(2631): a, c, t, g, unknown or other
  modified_base (2634)..(2636): a, c, t, g, unknown or other
  modified_base (2641)..(2644): a, c, t, g, unknown or other
  modified_base (2646)..(2647): a, c, t, g, unknown or other
  modified_base (2649)..(2655): a, c, t, g, unknown or other
  modified_base (2659)..(2659): a, c, t, g, unknown or other
  modified_base (2661)..(2661): a, c, t, g, unknown or other
  modified_base (2667)..(2670): a, c, t, g, unknown or other
  modified_base (2672)..(2674): a, c, t, g, unknown or other
  modified_base (2678)..(2679): a, c, t, g, unknown or other
  modified_base (2681)..(2681): a, c, t, g, unknown or other
  modified_base (2683)..(2683): a, c, t, g, unknown or other
  modified_base (2685)..(2693): a, c, t, g, unknown or other
  modified_base (2695)..(2698): a, c, t, g, unknown or other
  modified_base (2700)..(2700): a, c, t, g, unknown or other
  modified_base (2703)..(2703): a, c, t, g, unknown or other
  modified_base (2712)..(2712): a, c, t, g, unknown or other
  modified_base (2715)..(2715): a, c, t, g, unknown or other
  modified_base (2718)..(2719): a, c, t, g, unknown or other
  modified_base (2722)..(2723): a, c, t, g, unknown or other
  modified_base (2726)..(2727): a, c, t, g, unknown or other
  modified_base (2730)..(2730): a, c, t, g, unknown or other
  modified_base (2733)..(2733): a, c, t, g, unknown or other
  modified_base (2737)..(2737): a, c, t, g, unknown or other
  modified_base (2740)..(2742): a, c, t, g, unknown or other
  modified_base (2745)..(2745): a, c, t, g, unknown or other
  modified_base (2748)..(2752): a, c, t, g, unknown or other
  modified_base (2755)..(2758): a, c, t, g, unknown or other
  modified_base (2762)..(2762): a, c, t, g, unknown or other
  modified_base (2787)..(2787): a, c, t, g, unknown or other
  modified_base (2829)..(2829): a, c, t, g, unknown or other
  modified_base (2844)..(2844): a, c, t, g, unknown or other
  modified_base (2853)..(2853): a, c, t, g, unknown or other
  modified_base (2874)..(2874): a, c, t, g, unknown or other
  modified_base (2911)..(2916): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtgcccgaagacttccccaatgtgccaatcattgccgtcaaccggtacccacactttcccgggttcatgcggaaaattgacgtaatttttattcaaaatttgnnnnnnnnnnnnnnnnnncagtacaaggcaaaactcccctatgtgggtgtgtttgtcaaaaaggatgatcangacaaatccgaagcggtgccctcaatcagtcgcctttacacagtcggcaccttctcgcccatcttcgacatgtacaaccccggcaagggaatgcacctcattttgagcgcccaccgccgaatccggattctccacccgttggaccccaaaacgtccgccgactttgcccgaatgaatgggagaagaacgggcagaggtcggaaagcgaaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataaaaattttcaggtaaaaatgcaagccatcatgacaatgatccgcgagatcatccacctggacacaatgctggcccagcanctggcnctgntgatgcancccgaaccncaaattgtgaacaacccaatcaatttntgcgatctggtcggctcgctggcgcagaattcggaaacngaggagctgcaaaatttcatggaggaattgaatgtaanncgacgtcttgaaattgcactggaattgctggaaaaggaacgggcccgtgcaaaaatgctgcgtgaaattcggcaaagtgtggagaagaaagtgcaagaacaacaccacaagtacatgctcaatgaacagttgaaagcaatcaaacgcgagttgggcattgagaaggacnnnaaacaggcggtgctggagaagctagacgagcgcctgaaagagctgaaagtgcccgagtatgcgatgaaggtgatcaaggaggagcagaccaaactgtccttcctcgacccgcacagcagcgagtttagcatttcaggnaactacctggactggctgaccagcatcccgtggggcaaaacctcggaggagatcaaggacgtgaaatgggcccgagaagtgctggacgaggaccactacggcatgaaagacgtcaaggaacgcatcctggagttcattgctgtgggcattctgaagcagcaaaccaacgggaaaattctgtgcttccatgggccgccgggcgtgggcaagaccagcattgccaannnnnntnnnnnannnttnnntnnacagtattaccgcttctcngttggcggcatgnnngacgtngcnnnnatcaaaggccatngncgaanctannttngngcaatgcccggcnagntnatcnaatgcntgaaganngtccanaccgagaacccgntgntgctcattgatgaggtcgacaaanttggnnnnnctggctaccacggngaccccgcctcggccctgttggaagtgttggaccccgaacagaactccaacttngtggaccanttcatcgangtgcccgtggatttgtccaaagtnctnttcatntgnaccgccaatgtgattgaccgcattccgggcccactgaaggaccgcatggaaatgatcgaggtgtcgggctatgtggccgaggagaagatggagattgccaagaagtacttggtgccaaagtgccgagagaaacgngcccttcccgaagaaaanctgntnatcaaggatgaggccattgacacactgatcaagtcgtactgncgcgagtctggcgtgcgcaacctggagaagcacttggaaaaggtttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggatttgtggggcgcgaaaagttcaccagtgaacgcctttatgagcaaactccggttggcgttattatgggcctagcttggacggcaatgggtnnnnnnnnnnnnnnnnnnnnnnnnnnnnnnnnnnnnnnnnnnnnnnnnnnnnnnnnnnnnnnnggcaatttggaagcgaccggccacctcggcgatgtcatgaaggagtccatgcggacggcctacacggtggcgaaaaatgtgctgatgcggaaggatccggagaatgattttctggaacatgcccacattcatgtgcacgtgcccgagggtgcaaccccaaaggatggcccntcnnntggcnnnncnntnnnnnnngccntnctctcnnnngnnntggnncngncnnnnnnnnngnnnntngcnatgaccggngangtnncgnngannggnaanattntgnnnatnggnnnnntcnnnnaaanaataattgctgccaaacgggccggngtcagccgcgtcattttgccggaagaaaacaagaaggacttngatgacctcgcgganttcatcaancgggacgtggacgtgcacttngtgtcgcactatgaccaaatctttgagctgcttttcnnnnnn

SEQ ID NO: 704 - DNA, 1374 bp, Artificial Sequence
  Description of Artificial Sequence: Synthetic polynucleotide
  modified_base (1)..(90): a, c, t, g, unknown or other
  modified_base (242)..(242): a, c, t, g, unknown or other
  modified_base (277)..(277): a, c, t, g, unknown or other
  modified_base (294)..(294): a, c, t, g, unknown or other
  modified_base (300)..(300): a, c, t, g, unknown or other
  modified_base (330)..(330): a, c, t, g, unknown or other
  modified_base (368)..(368): a, c, t, g, unknown or other
  modified_base (381)..(381): a, c, t, g, unknown or other
  modified_base (468)..(468): a, c, t, g, unknown or other
  modified_base (534)..(534): a, c, t, g, unknown or other
  modified_base (564)..(564): a, c, t, g, unknown or other
  modified_base (792)..(792): a, c, t, g, unknown or other
  modified_base (943)..(948): a, c, t, g, unknown or other
  modified_base (951)..(951): a, c, t, g, unknown or other
  modified_base (954)..(954): a, c, t, g, unknown or other
  modified_base (957)..(957): a, c, t, g, unknown or other
  modified_base (1170)..(1170): a, c, t, g, unknown or other
  modified_base (1366)..(1374): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaactgttttgcttggtgcccaatggggtgatgagggcaagggaaaagttcttgattttcttatcggacaccacaaggttgacgttgttgctcgttgccaaggcgggaacaatgccgggcacacggttgtggcgaatggtcgggaatatgntttccatttgcttccatccggaattgcgtccagcnactgtttgaatgttatnggcaanggggttgtcgtcaatttggacgctcttttntccgaacttgaacgcaatgggttcacaaatgagaccanctgggagaagcgnctgttcatcagtgattgcgcccatttggtgctgccaatccacattgaagcggatggacgccaagaactaaagctcggcgacaaagcnaaaattggcacaaccaagcgcggcattggaccgacttattcgagcaaatgttttcgaaccggtgtncggattgccgatttgctcgatgatccggtnaattttgagaggaagtattaaaatgaatgtggaggaggacatcgcaaaattgaaggttttaaaacaagtatatcttttttatgattaaaattctagcattttgctgagcggctaaaaaagcttaatttggtgtgcaacacaacaatgcttttgcacaagtatcggcagcaaggcaaatcaattcttgtggaaggagcaaatggcgctttgcttgacattgatttcgtnacttacccttttgtgacctcatcgaatgccacagtcggcggtgcttgcactggattgggaattccaccaacggccataacaagcatcattggcgtggtcaaagcgtatcaaacccgagttggtgccggtccatttccaacggagttgcttnnnnnnganggnganaaactccagcagatcggcaaggaaattggcgtcacaacgggccgaaaacgccgctgtggttggcttgacttggtgctgcttcgttatgcatgcattgtgaacggatttacttcgctggcagttacaaaagtggatgtgctggatacgttcaaggaaatcaaagtggcaaccggctatgtgctcaatgggaaacaactggaatgcccaccaganacgcctgacgattggtcccatatcgaagtccagtacaaaagctttcccggctggatgaccaacaccactcaaataagagactatgcgaatttgccagacgcctgcaaaagctatttggaatttttagaaaaggagctttccgttcccatcaaattcattggagttggcaaaagcagagagtccttgattgttcgcnnnnnnnnn

SEQ ID NO: 705 - DNA, 552 bp, Artificial Sequence
  Description of Artificial Sequence: Synthetic polynucleotide
  modified_base (154)..(162): a, c, t, g, unknown or other
  modified_base (244)..(244): a, c, t, g, unknown or other
  modified_base (279)..(279): a, c, t, g, unknown or other
  modified_base (288)..(288): a, c, t, g, unknown or other
  modified_base (321)..(321): a, c, t, g, unknown or other
  modified_base (324)..(324): a, c, t, g, unknown or other
  modified_base (333)..(334): a, c, t, g, unknown or other
  modified_base (339)..(339): a, c, t, g, unknown or other
  modified_base (348)..(349): a, c, t, g, unknown or other
  modified_base (352)..(357): a, c, t, g, unknown or other
  modified_base (359)..(361): a, c, t, g, unknown or other
  modified_base (363)..(365): a, c, t, g, unknown or other
  modified_base (369)..(369): a, c, t, g, unknown or other
  modified_base (414)..(414): a, c, t, g, unknown or other
  modified_base (436)..(436): a, c, t, g, unknown or other
  modified_base (442)..(442): a, c, t, g, unknown or other
  modified_base (444)..(445): a, c, t, g, unknown or other
  modified_base (447)..(447): a, c, t, g, unknown or other
  modified_base (454)..(454): a, c, t, g, unknown or other
  modified_base (465)..(465): a, c, t, g, unknown or other
  modified_base (467)..(467): a, c, t, g, unknown or other
  modified_base (469)..(469): a, c, t, g, unknown or other
  modified_base (475)..(475): a, c, t, g, unknown or other
  modified_base (480)..(480): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (504)..(504): a, c, t, g, unknown or other
  modified_base (515)..(515): a, c, t, g, unknown or other
  modified_base (518)..(518): a, c, t, g, unknown or other
  modified_base (534)..(534): a, c, t, g, unknown or other
  modified_base (541)..(552): a, c, t, g, unknown or other
atggtgcgcaagctgaagtaccacgagaagaagttgctgaagaaggtggacttcatccattgggaggtggacaacagtctgcacgagaaccaaataatgcgccgctaccacatcgagaagcgggaacattatacgctgtacaacaaactctcannnnnnnnncgcgagatggccaagcgcatccgggacctggaggacagcaaccccaacaagcccatcctggcccgtcggctgctcggcaaantgttcgacattgggctgatccccacggcggacacnctggagcgntgcgatcggatcaccgcctcctccttttgccgncgncgtttgccnntggtngtgcgcaannctnnnnnngnnncnnnggtncaaaaagccagccaaatggtggagcacgggcacatccgagtcggngtggaaatgatcactgatccgnccttcntnntnacccgcntccaatccgancnantcaccnggacncgnggctccaanatnaagaagcangtgcacacctnccngaaccaacgggacgantttgagnnnnnnnnnnnn

SEQ ID NO: 706 - DNA, 813 bp, Artificial Sequence
  Description of Artificial Sequence: Synthetic polynucleotide
  modified_base (90)..(90): a, c, t, g, unknown or other
  modified_base (151)..(210): a, c, t, g, unknown or other
  modified_base (330)..(330): a, c, t, g, unknown or other
  modified_base (379)..(381): a, c, t, g, unknown or other
  modified_base (427)..(474): a, c, t, g, unknown or other
  modified_base (652)..(813): a, c, t, g, unknown or other
atgaacgaagcagcgtttgatgtcgccctggacttgatgcgtcggctgccaccgcaaggctgtgagaagcatctgactgatttggtggcnctggcaccggatttgtgcgaatccctgttgaccgccgtggaccagccgttgaaagttgcannnnnnnnnnnnnnnnnnnnnnnnnnnnnnnnnnnnnnnnnnnnnnnnnnnnnnnnnnnntttaggtccccctggacaaacacctatgacccgccgctggaggacggggttgtgccctcggaccggatccgaaaactcgagattgaaatcaatgccgcatttgaggcctaccgtgacgtntacttcgagggcggcgtctccagcgtctacttttgggacattgacaacnnngggttcgccggggtggttctgctgaagaaggagaccgacgggagcnnnnnnnnnnnnnnnnnnnnnnnnnnnnnnnnnnnnnnnnnnnnnnnncagacctcgaagcacgtgaagtacaagctgaccagcacggtgatgctctggctgcagaccaaccccacaaccacgggcaccatgaacctgggcggctccctgacgcgccagcacgagcaggacgtggtcctgaatgagcagagccctcaccttgtgaacattggcaaaatgattgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 707 - DNA, 1590 bp, Artificial Sequence
  Description of Artificial Sequence: Synthetic polynucleotide
  modified_base (1)..(6): a, c, t, g, unknown or other
  modified_base (105)..(105): a, c, t, g, unknown or other
  modified_base (123)..(123): a, c, t, g, unknown or other
  modified_base (166)..(168): a, c, t, g, unknown or other
  modified_base (249)..(249): a, c, t, g, unknown or other
  modified_base (312)..(312): a, c, t, g, unknown or other
  modified_base (321)..(321): a, c, t, g, unknown or other
  modified_base (396)..(396): a, c, t, g, unknown or other
  modified_base (399)..(399): a, c, t, g, unknown or other
  modified_base (438)..(438): a, c, t, g, unknown or other
  modified_base (445)..(445): a, c, t, g, unknown or other
  modified_base (1086)..(1086): a, c, t, g, unknown or other
  modified_base (1414)..(1414): a, c, t, g, unknown or other
  modified_base (1416)..(1416): a, c, t, g, unknown or other
  modified_base (1418)..(1418): a, c, t, g, unknown or other
  modified_base (1429)..(1429): a, c, t, g, unknown or other
  modified_base (1485)..(1485): a, c, t, g, unknown or other
  modified_base (1488)..(1488): a, c, t, g, unknown or other
  modified_base (1506)..(1506): a, c, t, g, unknown or other
  modified_base (1512)..(1512): a, c, t, g, unknown or other
  modified_base (1588)..(1590): a, c, t, g, unknown or other
nnnnnnccagtgcgtgtgctcaaagccagtgcgcaagaggagcgtggtgaaaccgcacgactttcctcatttgttggcgcaacagcaatcggtgacttggtgaanaccacacttggacccaanggaatggacaaaattttaataagcggctcaggcgagcatcagnnnaacgttcaagtcacaaatgatggtgccaccattcttaaatccattggtgttgacaatccggctgcaaaagtgcttgttgcnatttcgctgacccaggacaaggaagttggcgatggcacaacctcggtgaccgtttttgcggcngagttgctnaaagaggcggaaaccatgattggccagcgcatccatccccaagtgatcatttcgggctatcgaaaagcactgacngtngccaaagaggcgctcgagaaagccgcacatgcttcgggngagaatntgcgcgaagatttgatgaaaattgcaaaaacctcgttgggctccaaaatcctctcccagcattccgagcacttctccaagctggccgtcgatgccgtgatgcgtttgggcgaacaaggctcactggacgccattcaagtgatcaaaaagttgggcggttccatggaggactcctatctggaggagggtttcctgctggagaagaagccgggcatgttccagccacaacggttggaggatgcgaagattttgattgcgaacacgcccatggacacggacaagatcaaagtgttcggcagccgaatcaaagtggactcaattgcaaaagtggccgagctggagcaggcagagaaggacaaaatgaaggaaaaggttgaaaagatctgcgcccatggcataaacgtgttcatcaaccgccagctcatctacaactaccccgaacaactgtttgccgacaagaaggtgatggccattgaacacgccgattttgagggcatcgaacggctggcactggtgctgggcggtgaaatcgtgtccacctttgattcgcccgagaaggtgaagctgggcagctgcaaactcatcgagcaggtcaccattggggaggacactttgctgcgcttctccggcgttccacttgcncatgcctgctccgttgtgctgcgcggtgcgacccaacaaattctggacgaagcggaacgttccctgcacgacgctctctgcgtgttggccacccatgtgaaggacaagcgggttgtgccgggcgcgggtgcctcggaactgttgatggccactggggtgatggcggagagtcagaaagtgccgggcaaagagtcgctggccatggaggcgtatgcccgggcactggccaaactgccgaccatcatttgtgacaatgccgggctcgacagtgccgagctggtgtcgcgcattcgggcggaacatgcaaagggaaaccaccggcaaggcntngntgtggagaatngccgcatggcggatgtctacgaacttggcgtgctcgagtcctacaatgtgaagctnggngtgttggccagtggcacngaggcngctgaacagcttctccgcgtcgactgcatcatcaaatgtgcgccccggccacgcaccaaggaccgtcgcccgtgcnnn

SEQ ID NO: 708 - DNA, 1623 bp, Artificial Sequence
  Description of Artificial Sequence: Synthetic polynucleotide
  modified_base (1)..(66): a, c, t, g, unknown or other
  modified_base (297)..(297): a, c, t, g, unknown or other
  modified_base (1102)..(1104): a, c, t, g, unknown or other
  modified_base (1272)..(1272): a, c, t, g, unknown or other
  modified_base (1399)..(1401): a, c, t, g, unknown or other
  modified_base (1621)..(1623): a, c, t, g, unknown or other
nnnnnnnnnnnnnnnnnnnnnnnnnnnnnnnnnnnnnnnnnnnnnnnnnnnnnnnnnnnnnnnnnnttcaaggatcgtgacaaaccagaaagtgtgcgaactagcaatatagtggcggccaaggctgtgtctgattcggtccgaacaagcctaggcccacgcggtatggacaaaatgatccaggcatcaaacggtgaggtgaccataaccaatgatggagccacaatcctcaatcaaatgtctgtcgtgcatccaaccgctaaaatgctcgtagaattgtcgaaggcacaggacatngaggcgggagatggaacaaccacggttgttgttctggcaggttctttacttgacgcggccgagaagttgttggcaaaaggtttgcatccaaccacaatctccgattctttccgccgtgctgcggcctattccgagcaaatccttgaggatatggcaaccccgattgatctgaatgatgaggaggaattgaacaaattggcaacgaccagtctcaattcgaaggttgtctcccaacattcgcacattctggccccaatggccgtgcaagcggtcaaaaaattgatggcctcaccggaagagcagaacgtgaatctgaagatgataaagattgtgaagaagttgggagaaactgtcgacgagtcacagttgattgaaggcgcactcattgaacagaactcgatgggccatggcggaccaagtcgtatggagaaggcaaagattggactcatccagttccagatatctccgcccaaaaccaacatggagaatcaagtgatcatttcggattacacccaaatggaccgtgcgctgaaggaggaacgcaactacatcctcgagttgtgcaaacaaatcaaaaaggccggttgcaacgtgctgctcatccaaaagtccatcctgcgtgacgcaatcaacgaaatggcgcttcattttttcgccaaaatgaaaataatggtcatcaaggacattgagcgcgaagacatcgagttctactcaaaaatactcggctgtcgcccggtcgcttccgtggatcatttcacacccgagtcgcttggcaccgccgaccttgttgaggagattgaaaccnnngcggatggaaaagttgtcaaggttactggactcaagtcaagcgggaacgccgtgtccatcctcatccgtggctcaagcaagctggttcttgaggaggccgaccgttctctgcacgatgcactctgcgtcatccgctgtcttgtcaagaagcgggcattgctgccagtnggcggtgcacccgaaatggaagtctctgtaaaactccggcaagcagcacaaacaaaacagggagctgagcaatattgttggaaggcattcgcggaagctctggagctgatcccatacacactggccnnnaatgctggactttcacccattgggacggtgaccgagttgcgcacccaacatgcaaatggcaacaaagacttcggggtcaatgttcgaacgggagcggttacaaacattttggaggagaatgtggtccagcctttgctggtcacctcttttgcaatcaagcaggcggccgaatgcgtgcgtgccatcctgaagatcgatgatgttgtgctggcagtgcgtnnn

SEQ ID NO: 709 - DNA, 1629 bp, Artificial Sequence
  Description of Artificial Sequence: Synthetic polynucleotide
  modified_base (1)..(9): a, c, t, g, unknown or other
  modified_base (111)..(111): a, c, t, g, unknown or other
  modified_base (114)..(114): a, c, t, g, unknown or other
  modified_base (165)..(165): a, c, t, g, unknown or other
  modified_base (198)..(198): a, c, t, g, unknown or other
  modified_base (231)..(231): a, c, t, g, unknown or other
  modified_base (234)..(234): a, c, t, g, unknown or other
  modified_base (336)..(336): a, c, t, g, unknown or other
  modified_base (436)..(436): a, c, t, g, unknown or other
  modified_base (450)..(450): a, c, t, g, unknown or other
  modified_base (489)..(489): a, c, t, g, unknown or other
  modified_base (528)..(528): a, c, t, g, unknown or other
  modified_base (666)..(666): a, c, t, g, unknown or other
  modified_base (681)..(681): a, c, t, g, unknown or other
  modified_base (696)..(696): a, c, t, g, unknown or other
  modified_base (717)..(717): a, c, t, g, unknown or other
  modified_base (723)..(723): a, c, t, g, unknown or other
  modified_base (777)..(777): a, c, t, g, unknown or other
  modified_base (807)..(807): a, c, t, g, unknown or other
  modified_base (849)..(849): a, c, t, g, unknown or other
  modified_base (864)..(864): a, c, t, g, unknown or other
  modified_base (885)..(885): a, c, t, g, unknown or other
  modified_base (906)..(906): a, c, t, g, unknown or other
  modified_base (921)..(921): a, c, t, g, unknown or other
  modified_base (924)..(924): a, c, t, g, unknown or other
  modified_base (951)..(951): a, c, t, g, unknown or other
  modified_base (957)..(957): a, c, t, g, unknown or other
  modified_base (981)..(981): a, c, t, g, unknown or other
  modified_base (990)..(990): a, c, t, g, unknown or other
  modified_base (1189)..(1191): a, c, t, g, unknown or other
  modified_base (1627)..(1629): a, c, t, g, unknown or other
nnnnnnnnngcagccggccaattgctttttgacgagtccggccagccattcattgttatccgggaacaggaacgacaaaaacgcatcactgggatcgaggcactcaagagncanattttggccgcaaagcaagttgcgaacacgctgaaaacttcgctcggtccncgcggccttgacaaaatgttggttagcccgganggggaagttaccatcacaaatgatggcgccacnatnatgaagaacatggatgttgagcaccacgtggccaagctgatggtggagttgtcccaatcgcaggacgatgaaattggggatggcaccaccggtgttgtttgnctggccggtgccctgatggagcaggccgagtcgctgctggacaagggcatccatcccagcaagatttccgacggtttcgagatggcttgcaaacgggcgntggaaaagttggangcaattgccgagcaattccccatcgagaacaaggagtcnctggtgcgcagtgcaatgacctcgctgggatccaaattngtgaacaaatgtttgcgccaattggccgaaattgcggtggacgcggtgctttccgtggctgatttgcaacagcgggacgtcaacttcgaactgatcaaaattgtgggcaaaccgggcggtcaaatggaggacaccacnctggtgaagggcgtngtgattgacaaaacnatgagccacccccaaatgccncgccgnctggaaaatgccaaaatcgccattctcacttgcccattcgagccgccaaagccnaagaccaagcacaagttggacattggctcnacggaggagtacaagcaactgcaaaagtacgagcgcgacacntttgagaagatgatncaggaggtcaaagcgagtggngccactcttgccctgtgccantggggattcgacgangangcaaaccatttgctgctccatcacaanctgccngctgtccgatgggtgggaggaccngaaattgancttgtcgcaatcgcaacaaacggccgaattgtgccgcgctttgcggagttgacgcccgaaaagctgggctctgccggcctcgtgcatgaactcaagttcgggacggacaatgaccaaatgctgtgcattgagcaatgcccgaacacacgggcagtgaccgtccttattcgcgggggaaacaaaatggtcatcgaggaannnaagcgttctctgcacgacgccttctgtgtggttcgcaacctgattcgggacagcaaaattgtttatggcggcggtgctgccgagctggcctgctcaattgcggtcgctgaagaggcggacaaagtccaaggcatcgagcagtacgccttccgtgccttcgccgacgcactggaaagcattccggccgcgttggccgagaactcggggcttccctcgatcgacacactgaccgagctgaaggccagccagattgcgcagggagtggcccacctgggggttgactgtctccagcgaggcaccaacgacatgaaggcccagggcgtcatcgagacgctgctctccaagcgggaacaaatctcattggcaacacaggtggtgcgcatgatcctgaaaattgacgacgttcgcgtgcccgacgatgagcacctcggctacnnn

SEQ ID NO: 710 - DNA, 1620 bp, Artificial Sequence
  Description of Artificial Sequence: Synthetic polynucleotide
  modified_base (138)..(138): a, c, t, g, unknown or other
  modified_base (412)..(414): a, c, t, g, unknown or other
  modified_base (726)..(726): a, c, t, g, unknown or other
  modified_base (1039)..(1041): a, c, t, g, unknown or other
  modified_base (1227)..(1227): a, c, t, g, unknown or other
  modified_base (1314)..(1314): a, c, t, g, unknown or other
  modified_base (1317)..(1317): a, c, t, g, unknown or other
  modified_base (1438)..(1443): a, c, t, g, unknown or other
  modified_base (1486)..(1486): a, c, t, g, unknown or other
  modified_base (1488)..(1488): a, c, t, g, unknown or other
  modified_base (1527)..(1527): a, c, t, g, unknown or other
  modified_base (1530)..(1530): a, c, t, g, unknown or other
  modified_base (1555)..(1555): a, c, t, g, unknown or other
  modified_base (1612)..(1620): a, c, t, g, unknown or other
atggcttcaattgcttgtcttaatcccaaagccgaacttgcccgacatgcagccgccctggagatgaacatcagcggtgccaagggtttacaggaagtgatgaagaccaacttgggaccgaaaggaacattgaaaatnctcgtttctggttcgggcgacctgaaagtgaccaaagatgggaatgtgcttctgcatgaaatgcaaatccaacacccgaccgcatcgctgattgcaaaagcctgcacggcacagaatgacgccaccggcgatggcaccacctccaccgtgctgctcattggggaactgctgaaacaggccgagacctacatcagtgatggcgttcatccccacttgatcacggaaggctttcaaaccgcctacgatgcgctcgtcaagttgctgcacgagttcnnnaagcaggcgcctattgaccgcaatttgctgattgaagtggcgcgcactgcgctccgaaccaaactggaccagaaattggccgatcacatcacggagtgcgttgtggatgcggtcctggccattcgcaaggatgagaaggagccggacttgcacatgattgagattcagcaaatggaacacgagatggagtcagacaccaagttgatccgaggccttgtgcttgaccatggcggtcgccatccggacatgccgaaaactttggagaatgtgtacattctcacgtgcaatgtttcgctggagtttgagaagacngaagtcaattccggccttttctacaaaacggctgccgagcgcgaacgcctgttgcaagccgagcgcgagtacatcaccagacgagtgcagaaaatcattgagctgaagaagcaagtctgtgacgctgcgggcgatggaaaaccccaaggctttgtggtgatcaaccaaaagggcattgacccgccctcgctcgacctgctcgcccaaaacggcattctggcactgcgccgtgccaagcgccgcaacatggaacgcctccagctggcgtgtggcggagaggcagtgaatgcggtggacgacctgacaccgaagnnnttgggttgggcgggctctgtgtacgagcatgttttgggcgaagacaagtacaccttcatcgaggactgcaagcacccaaagtcggtgaccctgctgctgaagggccccaacaagcacacaatcaaccagatcaaggacgccatctacgatggcatccgggcggtgttcaacgtgctcaaggatgtngccgtcattcctggcgctggtgcctttgaaattgccggttattgcacgttgaaaaagctggcagagagcgtgaaaggacgtgccaanctnggcgttttggcctttgccgaagccctcctgatcatccccaaaacgctggccgtcaatgcgggccacgatgcgcaggatgtgattgtgaagttggtcgaagcgtacaatgggatgggcagtnnnnnngccgttgggttggatgtggccagcggggaggcgaccattccananggcatttgggacaatgtgcgcgtgaagcaggccagcctngcngcctgtcaaagcattgccagcaatntgttggaggtggacgaggtgatgcgggccggcatgcgcgacttgaagcagggacagnnnnnnnnn

SEQ ID NO: 711 - DNA, 1608 bp, Artificial Sequence
  Description of Artificial Sequence: Synthetic polynucleotide
  modified_base (118)..(120): a, c, t, g, unknown or other
  modified_base (157)..(157): a, c, t, g, unknown or other
  modified_base (161)..(161): a, c, t, g, unknown or other
  modified_base (168)..(168): a, c, t, g, unknown or other
  modified_base (264)..(264): a, c, t, g, unknown or other
  modified_base (432)..(432): a, c, t, g, unknown or other
  modified_base (829)..(832): a, c, t, g, unknown or other
  modified_base (847)..(847): a, c, t, g, unknown or other
  modified_base (877)..(877): a, c, t, g, unknown or other
  modified_base (898)..(898): a, c, t, g, unknown or other
  modified_base (900)..(900): a, c, t, g, unknown or other
  modified_base (912)..(912): a, c, t, g, unknown or other
  modified_base (1063)..(1063): a, c, t, g, unknown or other
  modified_base (1218)..(1218): a, c, t, g, unknown or other
  modified_base (1576)..(1581): a, c, t, g, unknown or other
  modified_base (1606)..(1608): a, c, t, g, unknown or other
atggcatcggtaccaataatcttgctaaaggaaggcacacaaacgaaacaaggacgtggccagatattgagcaacataagcgcatgctgtgccgttgccgacaatgtccgcacaactnnngggcctcgaggattggataagcttttggttgatcgtnaagnacaaacnaccatttccaacgatggagcaaccattctgaagcaacttgacattgtttacccggctgctgttgtgatgtgcgacattgcgaagagtcaggatgcngaagttggtgatggcacgaccagctttgtaattttggctgccgagtttttgaaggctgccaagccatttgttgaggagggcgtcagtccgcagctggtcatcaaggcgttcaacgccgcatcccaagaagccatcaaaaagttgcgggagttggcgatcaaagtggcnggcagcaatgagagtcgcgagatgctggttcgttgcgcggccacaacgctcagcagcaaattggttaaacaagaacgtcaccatttcgccacaatggttgtggacgcggtcagctatcttgacattgacttgccgctgaacatgattggcatcaagaaagtcagcggtggctcaattaaggattcacgactggtcaagggcgttgccttcaaaaaggcgttcagctatgccggctttgagatgcaacccaaacactacaagagcccattgattgcggtgctgaacattgaattggagttgaaggcggagaaggagaatgccgagctgcgcattgggaatgtggccgactatcaagaggtggtcaacgcggaatggaccattctgtacaacaaactcnnnnaaatacacgaaagtngggccaagattgtcctctccaagctgcccnttggcgatgtggcgacccaangntttgcggacagngacatgttttgcgctggccgagtccaagaagaggacctgaaccgtgtcattgcctcatgcggcggctccatgctgaccactgtttctcaaatcgacaagtcagtcctcggctgttgtgacgagttttacgagcaacaagttggcagtgaanggtacaacttcttcattggcggttccaaggcaaagtcgtgcactctcatcctccgcggtggttccgagcagttcattgccgaaacggaacgctccctgcacgatgccatcatgattgttcgacgtgccatgaagaacgacaccattgttgccgcnggtggtgcaattgaaatggaactatccaaacatctccttgaactggccaacaatcgcgaaatgaaggaccaatttttctggaaaggatttgccaaagcttttgagattgtgccccaacaattgtgccataatgccggcctcgatgccatcactttgttgggcgaattgcgagctgcacacatgaaaggccagaagtgggccggcattgacatccaaaaggagtgcgtggccgacaacatggagggatgcatttgggagccggcactcgttaaggagaacgcgatcatctcggccacggaagcgacttgccttgtgctgagcattgaccagaccatcaagaacccgaaaacaaagaacnnnnnngagatgccgggactgcctgggcagnnn

SEQ ID NO: 712 - DNA, 5046 bp, Artificial Sequence
  Description of Artificial Sequence: Synthetic polynucleotide
  modified_base (1)..(36): a, c, t, g, unknown or other
  modified_base (246)..(246): a, c, t, g, unknown or other
  modified_base (396)..(396): a, c, t, g, unknown or other
  modified_base (1497)..(1501): a, c, t, g, unknown or other
  modified_base (1503)..(1507): a, c, t, g, unknown or other
  modified_base (1509)..(1509): a, c, t, g, unknown or other
  modified_base (1511)..(1512): a, c, t, g, unknown or other
  modified_base (1515)..(1518): a, c, t, g, unknown or other
  modified_base (1520)..(1520): a, c, t, g, unknown or other
  modified_base (1522)..(1527): a, c, t, g, unknown or other
  modified_base (1529)..(1532): a, c, t, g, unknown or other
  modified_base (1534)..(1537): a, c, t, g, unknown or other
  modified_base (1564)..(1566): a, c, t, g, unknown or other
  modified_base (1575)..(1575): a, c, t, g, unknown or other
  modified_base (1578)..(1578): a, c, t, g, unknown or other
  modified_base (1606)..(1606): a, c, t, g, unknown or other
  modified_base (1623)..(1623): a, c, t, g, unknown or other
  modified_base (1628)..(1628): a, c, t, g, unknown or other
  modified_base (1644)..(1644): a, c, t, g, unknown or other
  modified_base (1677)..(1677): a, c, t, g, unknown or other
  modified_base (1759)..(1759): a, c, t, g, unknown or other
  modified_base (1780)..(1780): a, c, t, g, unknown or other
  modified_base (1785)..(1785): a, c, t, g, unknown or other
  modified_base (1821)..(1821): a, c, t, g, unknown or other
  modified_base (1854)..(1854): a, c, t, g, unknown or other
  modified_base (1866)..(1866): a, c, t, g, unknown or other
  modified_base (1874)..(1874): a, c, t, g, unknown or other
  modified_base (1929)..(1929): a, c, t, g, unknown or other
  modified_base (2297)..(2297): a, c, t, g, unknown or other
  modified_base (2313)..(2313): a, c, t, g, unknown or other
  modified_base (2346)..(2347): a, c, t, g, unknown or other
  modified_base (2350)..(2350): a, c, t, g, unknown or other
  modified_base (2389)..(2389): a, c, t, g, unknown or other
  modified_base (2402)..(2402): a, c, t, g, unknown or other
  modified_base (2416)..(2416): a, c, t, g, unknown or other
  modified_base (2480)..(2480): a, c, t, g, unknown or other
  modified_base (2566)..(2566): a, c, t, g, unknown or other
  modified_base (2595)..(2595): a, c, t, g, unknown or other
  modified_base (2838)..(2838): a, c, t, g, unknown or other
  modified_base (3080)..(3081): a, c, t, g, unknown or other
  modified_base (3449)..(3449): a, c, t, g, unknown or other
  modified_base (3453)..(3453): a, c, t, g, unknown or other
  modified_base (3460)..(3460): a, c, t, g, unknown or other
  modified_base (3513)..(3513): a, c, t, g, unknown or other
  modified_base (3518)..(3518): a, c, t, g, unknown or other
  modified_base (3537)..(3537): a, c, t, g, unknown or other
  modified_base (3546)..(3546): a, c, t, g, unknown or other
  modified_base (3549)..(3549): a, c, t, g, unknown or other
  modified_base (3564)..(3564): a, c, t, g, unknown or other
  modified_base (3580)..(3580): a, c, t, g, unknown or other
  modified_base (3591)..(3591): a, c, t, g, unknown or other
  modified_base (3611)..(3611): a, c, t, g, unknown or other
  modified_base (3639)..(3639): a, c, t, g, unknown or other
  modified_base (3642)..(3642): a, c, t, g, unknown or other
  modified_base (3826)..(3826): a, c, t, g, unknown or other
  modified_base (3963)..(3963): a, c, t, g, unknown or other
  modified_base (3993)..(3993): a, c, t, g, unknown or other
  modified_base (4017)..(4017): a, c, t, g, unknown or other
  modified_base (4036)..(4036): a, c, t, g, unknown or other
  modified_base (4041)..(4041): a, c, t, g, unknown or other
  modified_base (4053)..(4053): a, c, t, g, unknown or other
  modified_base (4186)..(4186): a, c, t, g, unknown or other
  modified_base (4193)..(4193): a, c, t, g, unknown or other
  modified_base (4217)..(4217): a, c, t, g, unknown or other
  modified_base (4245)..(4245): a, c, t, g, unknown or other
  modified_base (4265)..(4265): a, c, t, g, unknown or other
  modified_base (4288)..(4288): a, c, t, g, unknown or other
  modified_base (4293)..(4293): a, c, t, g, unknown or other
  modified_base (4305)..(4305): a, c, t, g, unknown or other
  modified_base (4332)..(4332): a, c, t, g, unknown or other
  modified_base (4394)..(4394): a, c, t, g, unknown or other
  modified_base (4414)..(4419): a, c, t, g, unknown or other
  modified_base (4422)..(4423): a, c, t, g, unknown or other
  modified_base (4425)..(4426): a, c, t, g, unknown or other
  modified_base (4428)..(4428): a, c, t, g, unknown or other
  modified_base (4431)..(4431): a, c, t, g, unknown or other
  modified_base (4849)..(5046): a, c, t, g, unknown or other
nnnnnnnnnnnnnnnnnnnnnnnnnnnnnnnnnnnnctgcaaaaagcgggaataaaccaagacaatatcaactttgccaatgtcacgatggaatcggataagtacattgtggtccgtgaaaaggttggcgattctgcccaggtggtaattctggatgtggccagccccaatgacgttataagaaggccgataagcgctgattcagcacttatgaatccgaataccaaaattcttgcgctcaaattngctaaaactctgcaaatctttgacctggaccaaaagaccaaagtgaagacccacgtggccaccgaagacgttatgttctggaaatggattaatccggacataattggaattgtgacagaaaattcggtgtaccattggtctttgacagcngaatcagctccggtaaaagtatttgaccggcattcaacattgcaaaacacacaaattatcaactatcgttccgatgcagaagggaaatttttgttgttgattgggattgctgcaaaggagtctcgagtagttggatcaatgcaactttacagtactgaaagaaaagtgtcacagcccattgaaggacatgctgcttgtttcacccaatacaagatggaggggaatccacaccccagcaatctgttttgtttctccctgcgaaatgcaaccggaggaaagttgcacatcgtcgaagtttcttcaagtcctcaaggcaatcaaccgtaccagaaaaaggccatcgatgttgcctatccagcggatgctacttccgactttccagtgtctatgcaagcatcatccaaacacggcatcttgtacatgattaccaagtatggatatgtgcatctgttcgacattgagagcggattctcaatattcaccgttcgcatctccactgacaccgtcttcatcacaaccgaatacaccgtgaacaatggtgttcttgggattaaccgctctggaaaggtcgtttgtgtggggttggatgagacaacagttgttccatatgtcacgcaacaacttcaaaacccggatttggctctaaaattggcttccagatgcaatttaccgggtgccgaggaattgttcgtcaggaaattcaatctgcttattggcaatgggaactacacagaagcagccaaagttgctgcaacggctcctcaaaacattctccgaacaccgcagacattgcaaaagttccagtcagcaccggtctcaggcaaaacaacgtcgccgctgttaatttatttcaacgcactccttgaacaaggcacattgaacaaatatgaatcactggaactctgtcgacccgttcttgcccagggaaggaagcagctcgtggagaaatggatttcggaagcaaagctggattgcagtgaagagttgggcgatttggtcaagcagcatgacattaacttggcgttgagcatttacttgcgcggaaatgtgccccacaaagttgtgcagtgttttgcggagatgggacagttcgacaagatnnnnntnnnnncnannaannnnantnnnnnncnnnntnnnnttttccaaatgcggcaagtgttgcgcnnnacacacccnganaatgcggctgcattcgctcaaatgctantcagcgaaggcccaaanggcgnaccgttggcagacatnaatcagattgttgactgctttgttgaagctggnaacatacaacaatgcacggctttccttttggaggcactcaaaggagacaacgaatcccaaagccatttgcaaactcgcctgntggaaatgaatttgctgtcgnacccncaagttgctgatgccatccttggcaacaacatgttnaatcattatgaccgcgcttcaattggccaactntgtgaaaaggcnggtcttcngcagagagcacttgagcatttcactgacttgtatgacatcaaacggacggtggtncacacgcaacattttaatccggagtggcttgtgaattattttgggcgtctcaatgttcaagactcactggaatgtttgaaggcaatgttgcaagccaatctccggcagaatctccaaatagtcgtccaaatcgcaacaaaatattgcgagcaattgacaactcaggcactcatcgaactctttgaatcgttcaaaagttatgaaggacttttttacttccttggttccatcgtgaactttagtcaagatccagaagtgcatttcaaatacattcaggcagccacgcgtactggacaaatcaaggaagttgagcgtatctgtcgcgaatcgaattgctatgatcctgagcgtgttaaaaactacctganggaagcgaaactcgcngaccagttaccattgataatcgtttgtgaccgnnacnacatggtacacgacctcgttctctacctttaccgaagcnatcaaatggaatncatcgaagtcttcntcagtaaagacaatccaagacgactgccggttgtgattggtgcacttcttgatgttgattgcgntgaggacaccataaagcagctcatccagaacacgcgtggaaaattcgatattgacgagcttgttgaggaagtggaaaagcgcaatngattaaaattgctgagctcatggttgganagtcgcgtccatgaaggaaatcaagaccaggcaacgcacaatgcgctggccaaaatttacattgattcaaacaacaacccagaacgcttccttcgcgacaatcaattctatgatcccaaagtcatcggcaaatactgcgagaaacgtgatccgcattatgctttggttgcatatgaacgaggcggctgtgatcatgagttcattgcggtttgcaatgaaaattcactcttcaaaagtttggcncgttatcttgtgcgtcgacgcgacaatgaactttgggcgagtgtgctagccgaagacaaccaacaccgtcggcaactcattgaccaagtagttcaaactgcgctctctgagacattggatcctgatgacatcacaatcaccgtgaaagcgtttatggctgcagatttaccaaatgaattgattgaacttcttgagaaaattgtgctggacaattcgacattcagcgagcacagaaatctgcnnaatctcctcatccttaccgcaatgaaagttgattctaccagagctgtgggatacattctgaatttggacaaatatgatgctccagctattgccaatattgccatcacaaacaaactttattgggaagcttttgccatttttcgcaaaactggtgtcaacgcttctgctattaaggtgctaatcgaacacttcaaaaatttgcgtcgtgcatacaaattcgctaagaaagtgaatgaagctccagtgtgggcagctctggcaaaggcccagttgaaggatggtcaagtgaaagaagccgttgattccttcatcaaagccgatgacccaagcgcatttatcgaggttgcgaagaaatgtgctgaaacagnccantgggagnatctggtgcgctatttgcaaatggctcgaaagcgatcccgagaatcattcatngaaancgaactgtgctttgccttngcaaaaacnggncgtctgacggaactngaggaattcatcacgnaaccaaatcangctcaaattcaacaagtcgntgaccgttgcacagaacaaggaatgaangangctgcacggattcttttcaatagcatcggcaattttgcaagactttcaacaactttggtccaacttggtgactaccccggggcaattgatgctgctcgcaaagccaattcgacaaagacatggaaacaggtgtgctttgcatgcgtcaacaaccaggaattcggactggcccaaatctgtggantgcacattgttgttcatgcggatgagttggaggaactcatcaattactaccaaaaccgcggccactttgacgaactaattgctttattggaagccgctttgggacttgaacgggcacacatgggaatgttcacagancttgccattctgtacagcaaatacaagccngagaaaatgcgcgaacatttggancttttctggtcccgtgtgnatatnccaaaggttttncaagctgcagaacatgctcatctctggtcagaattggtgttcctttatgacaagcacgaggagtacgacaacgccctactgaccatgatccaacatcctgccgaagcatggcgtgaacagcatttcaaggaanttgttancaaggtcgcagatgttgagctctnctacaaggccatccaattttatctcgancacaaaccaacattattgantgaattgttgacggtcttgtccncgcgncttgatcaaacncggactgttgcaatcttccaagaattnggcaatccatcgcttgtgcaaccataccttcgtcaagtgcaaaatttgaacaacaaggcacncaatgaatgcctgaatcaannnnnnatnnannangangattttgagtccctcaaagccagcattgagacatacgacaattttgacaacatcactctggcacaacagcttgaaaatcaccaacttgttgagtttcgacgaatctcggcctatctttacaagggcaacaaccgctggaagcaatctgtcgaactttgcaagaagaagaaattattttaggatgcaatggactatgccgcggaaagccgtcaaatggaaatcgtcgaagacctcatgaaattcttcctgaaggaagggctgaatgattgtttctccgctcttctctataaatgctatgacctgttgcgaccggatgttgtcctggagctggcttggcgccataaacttgttgattgtgccatgccttatatggtccagactgtgcgtgattttggatcaagggtattttttattgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 713 - DNA, 858 bp, Artificial Sequence
  Description of Artificial Sequence: Synthetic polynucleotide
  modified_base (1)..(165): a, c, t, g, unknown or other
  modified_base (193)..(193): a, c, t, g, unknown or other
  modified_base (360)..(360): a, c, t, g, unknown or other
  modified_base (595)..(595): a, c, t, g, unknown or other
  modified_base (607)..(608): a, c, t, g, unknown or other
  modified_base (610)..(611): a, c, t, g, unknown or other
  modified_base (614)..(620): a, c, t, g, unknown or other
  modified_base (622)..(626): a, c, t, g, unknown or other
  modified_base (628)..(638): a, c, t, g, unknown or other
  modified_base (640)..(640): a, c, t, g, unknown or other
  modified_base (642)..(642): a, c, t, g, unknown or other
  modified_base (644)..(645): a, c, t, g, unknown or other
  modified_base (651)..(651): a, c, t, g, unknown or other
  modified_base (669)..(669): a, c, t, g, unknown or other
  modified_base (672)..(673): a, c, t, g, unknown or other
  modified_base (699)..(699): a, c, t, g, unknown or other
  modified_base (723)..(723): a, c, t, g, unknown or other
  modified_base (741)..(741): a, c, t, g, unknown or other
  modified_base (762)..(762): a, c, t, g, unknown or other
  modified_base (847)..(858): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtcaaaacggtttttgcgaatgtgncaaagaaatatgatttaatgaacgacgcaatgagccttggcattcaccggctgtggaaggattattatgtgcaaagattgaaaattgccaaggacagtcaaattattgatgtagcaggcggtacaggcgacattgctttccgggcacttgatactctcaaaacattnttagttacctttaaatttaatttgaagaaaatgctcgacattgggagaagccgcgcttccagcaaaccaacggggattgctgatcacctcaattgggtccctgccgacgcagaggcactcccattcccggacaacacattcgacatctacaccatagcattcggcattaggaactgtacccatccagacaaagtcctttctgaggcttttcgtattctgaaaccaaatggtatgnttattgttgttnncnnatnnnnnnntnnnnntnnnnnnnnnnncntnanngacgcntacagttttcaaatgatnccnntgatgggacaaatacttgtgggcgantttgacagctacaaatacttggtngaaagcatacgggtcttnccaaatcaatggaaattctcncagatgattaaggaggccggttttagaaaagtgacttatgaacaactttcctttggaatcagtaacatttacactggaataaagnnnnnnnnnnnn

SEQ ID NO: 714 - DNA, 1149 bp, Artificial Sequence; identical to SEQ ID NO: 339
  Description of Artificial Sequence: Synthetic polynucleotide
  modified_base (186)..(186): a, c, t, g, unknown or other
  modified_base (859)..(1149): a, c, t, g, unknown or other

SEQ ID NO: 715 - DNA, 858 bp, Artificial Sequence; identical to SEQ ID NO: 141
  Description of Artificial Sequence: Synthetic polynucleotide
  modified_base (1)..(183): a, c, t, g, unknown or other
  modified_base (207)..(207): a, c, t, g, unknown or other
  modified_base (225)..(225): a, c, t, g, unknown or other
  modified_base (234)..(234): a, c, t, g, unknown or other
  modified_base (288)..(288): a, c, t, g, unknown or other
  modified_base (300)..(300): a, c, t, g, unknown or other
  modified_base (507)..(507): a, c, t, g, unknown or other
  modified_base (841)..(858): a, c, t, g, unknown or other

SEQ ID NO: 716 - DNA, 1539 bp, Artificial Sequence
  Description of Artificial Sequence: Synthetic polynucleotide
  modified_base (1)..(156): a, c, t, g, unknown or other
  modified_base (258)..(258): a, c, t, g, unknown or other
  modified_base (604)..(738): a, c, t, g, unknown or other
  modified_base (760)..(760): a, c, t, g, unknown or other
  modified_base (775)..(775): a, c, t, g, unknown or other
  modified_base (787)..(787): a, c, t, g, unknown or other
  modified_base (789)..(789): a, c, t, g, unknown or other
  modified_base (821)..(821): a, c, t, g, unknown or other
  modified_base (852)..(852): a, c, t, g, unknown or other
  modified_base (855)..(855): a, c, t, g, unknown or other
  modified_base (1206)..(1207): a, c, t, g, unknown or other
  modified_base (1210)..(1213): a, c, t, g, unknown or other
  modified_base (1216)..(1216): a, c, t, g, unknown or other
  modified_base (1219)..(1222): a, c, t, g, unknown or other
  modified_base (1528)..(1539): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctccaccatgattgactacaaatggacactgatgggattggatgaccaatcggatgaatacaaacagaggataagagaatgccatcagagaggagcaacncgccttttaaaactggccaggcaaaatggtggtgttttcatcaaggttggccagcacattgcctccctgcaatatctcctacccgaaccctatacatcaaccctctctgtgcttcactcaaaggcgcctgaaagcactttgaaagagatttcggcagtcttcaaagcaaatctgcacaaaaatttggaggatgtttttgacaagttcgagccgcaaccttgtggggctgcttcccttgcccaagtgcataaagcacggctgaaagcaacgggcgaatacgtggccgtaaaagttcagcatccacatgtgaaggcgcgcagctttgtcgacatggccacaatgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgaatttatgcattttanagataccaaaaattnactatgaattgncnacaaaccaagtgctgacaatggaattttgtgngggcggtcaaatcaacgatttggactatttncangcgcacaagttggacaagcataaagtctgccgaatgcttggcaagctgtacagcgaaatgatctttgtccacggctacatccacagcgatccccacccaggaaatgtgctcgttaggagaagtgctcaaggcgaggaggaaatcatcttacttgatcatggactttacgttactctgcccgatgatttgcgcatcaattatgctcaattgtggctgtcccttatgcgtgcggacaaagaggagatccaaagggtttcggaacgcatgaatgttggcagcctttatggactgttcgcttgcattgtttccatgcgttcgtggaaggcggtcagtgaagggattgccagcacnnaannnnatnaannnnagaaacatcagattcgagaatttgccgcgtccctaattcctcaaatctctgtgcttttggatgccctcccacgccaaatgcttcttgtattgaaaaccaacgacttgctgaggagtattgccttcagactaaaagccgagcatcgcttggacagtttcaccgagatgtcgaaatattgcacccgagcagtttatgagtattcaatcagaagaagccactccctgatcgaacatttccgactcaatttggcgatgtacctgatgctaaccaaaatcacaatttatgaatattatttgaaaattttannnnnnnnnnnn

SEQ ID NO: 717 - DNA, 342 bp, Artificial Sequence; identical to SEQ ID NO: 241
  Description of Artificial Sequence: Synthetic polynucleotide
  modified_base (1)..(9): a, c, t, g, unknown or other
  modified_base (213)..(213): a, c, t, g, unknown or other
  modified_base (340)..(342): a, c, t, g, unknown or other

SEQ ID NO: 718 - DNA, 555 bp, Artificial Sequence
  Description of Artificial Sequence: Synthetic polynucleotide
  modified_base (1)..(42): a, c, t, g, unknown or other
  modified_base (248)..(250): a, c, t, g, unknown or other
  modified_base (252)..(252): a, c, t, g, unknown or other
  modified_base (418)..(555): a, c, t, g, unknown or other
nnnnnnnnnnnnnnnnnnnnnnnnnnnnnnnnnnnnnnnnnngaagaagccgaaggagttggacttccccagaaaggcctgaacatgatcatcaaggacgcgcttcccgacatgcggattgccaatgaaacacgtgagctgctgaaccaatgctgcgtggaattcatcaagcacgtgtctcgcgaggcccagcacatttcctcaaaggaccagcggaaaaccatttaccatgatcacgtgcagaaagnnntnaaaaatctcggcttcccgcgcgaatatgtggatgcggcaaattcggtgctgggcgagtgcaaaattgccgccgagaaacggctgaagcggaagaactcacggctggacaaatgtggcattcccgaagaacagctctggcaaatgcagcagcggcttattgaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 719 - DNA, 1596 bp, Artificial Sequence
  Description of Artificial Sequence: Synthetic polynucleotide
  modified_base (1)..(156): a, c, t, g, unknown or other
  modified_base (576)..(576): a, c, t, g, unknown or other
  modified_base (639)..(639): a, c, t, g, unknown or other
  modified_base (796)..(796): a, c, t, g, unknown or other
  modified_base (1132)..(1185): a, c, t, g, unknown or other
  modified_base (1356)..(1356): a, c, t, g, unknown or other
  modified_base (1501)..(1501): a, c, t, g, unknown or other
  modified_base (1503)..(1503): a, c, t, g, unknown or other
  modified_base (1505)..(1505): a, c, t, g, unknown or other
  modified_base (1539)..(1539): a, c, t, g, unknown or other
  modified_base (1541)..(1541): a, c, t, g, unknown or other
  modified_base (1575)..(1575): a, c, t, g, unknown or other
  modified_base (1584)..(1584): a, c, t, g, unknown or other
  modified_base (1593)..(1596): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacggatcctatggccttgttcaatcgacggagaaacgcgaaatccaatttgtggacattgggaaaattaatgcaagtctggacggtactcagatttggcttcgtggccggatccatgactcgcggggaaaaggcaaaaactgtttcatttgtattcgccagcggattcacagtgtccagggcgtgctctttgttgggccagagataagcaagcagttcgtaaagtttgcgcagaacatttccaaggagtccatcattgatgtgttcggcactgttgccaaaaccccatcgcctgtgtccagttgcacccaaagcgatgtggaaattcgcgtccaaaaattgtttgttgtgtccgcggcggagcctcgcttgccgttgcaaattgacgatgccagccgaccggagaacaaccaggacgancggagaacaaccaggacgaggggcttggcggttgtcaagctggacactcgacttgacaatcgngtgctcgaccttcgcaccccaaccagtcaggccattttccgccttcaggcagccgtttgtgctgctttccgctcatcattggccaagcggggtttcacggaaatccacacgcccaaaatcattccggctgccagtgaaggaggcgcaaatgtttttnaggtcagctatttcaaaggctccgcctacttggcccaatctccgcaactctacaagcaaatggcaatcgcgggcgactttgagcgcgtcttcaccattggcgccgtcttccgtgccgaagactcgaacacccatcgccacttgaccgaatttgtgggactcgacttggaaatggctttcaatttccactaccatgaggtactgtacacaattgctgaaatgctgttggaattgttcaagcatttgcaagccaatctccagcccgaaattcaagcagttggtcgacaatacccaagcgagcctttccttgtgcccgacaagccccttgttctacagnnnnnnnnnnnnnnnnnnnnnnnnnnnnnnnnnnnnnnnnnnnnnnnnnnnnnncaggatttgagcactccaaacgaaaagctgttgggccgccttgtccgagagcgttataagactgacttctacgtgctcgacaaatacccgctggtggtgcgtcccttctacacaatgcccgacccaaaggacgagcgctactccaacagctatgacatgttcatgcgagangaggagattctgtcgggcgctcagcgtgttcacgaccctgtgttgctcaccgaacgagccaaagtgcacaacgtggacatggacaagatcaagtcctacgtggatgccttcagatatggctgccctccgcacgctggcggtggantngnattggagcgtgtgactatgctctttctgggcctngncaatgtgcgcctttcttcgctgttcccgcgcgancccaagcgnatcaccccnnnn

SEQ ID NO: 720 - DNA, 2559 bp, Artificial Sequence
  Description of Artificial Sequence: Synthetic polynucleotide
  modified_base (171)..(171): a, c, t, g, unknown or other
  modified_base (177)..(177): a, c, t, g, unknown or other
  modified_base (189)..(189): a, c, t, g, unknown or other
  modified_base (192)..(192): a, c, t, g, unknown or other
  modified_base (438)..(438): a, c, t, g, unknown or other
  modified_base (547)..(549): a, c, t, g, unknown or other
  modified_base (1224)..(1224): a, c, t, g, unknown or other
  modified_base (1329)..(1329): a, c, t, g, unknown or other
  modified_base (1882)..(1884): a, c, t, g, unknown or other
  modified_base (2007)..(2008): a, c, t, g, unknown or other
  modified_base (2013)..(2013): a, c, t, g, unknown or other
  modified_base (2202)..(2202): a, c, t, g, unknown or other
  modified_base (2367)..(2367): a, c, t, g, unknown or other
  modified_base (2557)..(2559): a, c, t, g, unknown or other
atggtgaacttcacggttgacgaaattcgcgcccttatggacaagaagaagaacatccggaacatgtccgtcattgcccacgtcgaccatggcaaatcaacgctgaccgactcgttggtgtccaaggctgggatcattgctggcgcaaaggctggcgagacgcgtttcacngacacncgaaaggatgancangagcgttgcatcaccatcaaatcaacggccatttcgatgttctttgagctcgacccaaaagacttggacttcatcaagggcgacaaccaatgcgagctgcagcaagtggacggccagaacaagaagtacaacggcttcctgatcaacttgatcgactcgcccggacacgtcgacttctccagcgaggtcaccgctgctcttcgtgtcacggacggagccctggtggttgtggattgtgtttctgtngtttgtgtccaaacggagactgtgttgcgtcaggcgattgcggaacgcatcaagcccgtgctgttcatgaacaagatggaccgtgccctgctcgaactccaactcggcnnngaggaactcttccaaacgttccagcgcattgttgagaacatcaacgtgatcattgccacctacggggacgacgatggcccgatgggacccatccaagtggacccttcgattgggaatgtcggctttgggtcgggtctgcacggctgggccttcacgctcaagcaatttgccgagatgtatgccgacaagtttggtgtgcaggttgacaagttgatgaagaacctctggggcgaccgcttcttcaacctgaagacaaagaagtggacaaacacccaagagccggacaccaagcgcggattctcccaatttgtgctggatccaatctacaaagtgttcgactgcgtcatgaacatcaagaaggacgagaccagcaagcttgtggacaaactgggcgtcaaactgaccaatgaggagaaggaacaagagggcaaaccgctgctgaagacaatcatgcgcaagtggcttccggctggtgaaaccatgcttcagatgatttgcatacacttgccttcgccggtgactgcccaaaagtaccgaacggaaatgctttatgaaggcccgcacgatgatgaagcggctgtcgccatgaagacttgtgatccgaacgggccattgatgatgtacatctccaagatggtgccaacatcggacaagggccgcttctatgcatttgancgcgttttctcgggcaaagtcgcaactggaatgaaggcccgcatccaaggccccaactatcaagtcggcaagaaggaggacctttatgagaagacaatccaacgnaccatcctgatgatgggccgctacattgagcccattgaggacatcccagcggggaacattgccggattggttggcgtggaccagtacctggtgaagggcggcacaatcaccacctacaaggacgcccacaacatgcgtgtcatgaagttctccgtctcgcccgttgtgcgtgttgcggttgagccgaagaatgccggcgatttgccaaaattggtggaaggcctgaagcgtctggccaagtccgatcccatggtccaatgcatcttcgaggagtcgggcgagcacatcattgccggcgccggtgaactccacttggaaatctgcttgaaggacttggaggaggaccatgcctgcattcccatcaagaagtccgacccggtggtgtcctatcgcgaaacggtgacggaagagtccgagatcatgtgcctttccaagtcgcccaacaagcacaaccgtctcttctgcaaagcgcgtccattgcccgatggtctggccgaagcgatcgagaagggcgaagtcgacccgcaggatgagccgaagaaccgcgccaagnnnctggccgagaagtacgaattcgacgcaactgacgcccgaaagatctggtgctttggaccagagggcaccggctcgaacttgttggttgacgtgaccaagggagttcaatacttgaatgaaatnnaggantcggttgttgctggcttccaatgggccaccaaggagggcgtcctctgtgacgagaacatgcgcggcattcgcttcgacatccacgatgtgacactgcacgccgacgcaatccatcgtggcggtggccaaatcatcccgactgctcgccgtgtcttctatgcttccgtgctgactgctaagccacgcatncaagagcccgtctatctggtcgaaatccagtgcccggaagcggccgttggtggcatctacggagtgctgaaccgtcgccgtggtgttgtgttcgaagagagccaaattgccggcacaccgatgttcatcgtcaaggcacatttgcccgtcaacgagtcgtttgcnttcaccgccgatctgcgctccaacaccggtggacaagcgttcccacaatgtgtgttcgatcactggcaggttcttcccggcgatccgctggaggccaactctcgcccggcccaagtggttgcggacacgcggaaacgcaagggactgaaggagggcgtgcccggactggacaacttcttcgacaagctcnnn

SEQ ID NO: 721 - DNA, 771 bp, Artificial Sequence
  Description of Artificial Sequence: Synthetic polynucleotide
  modified_base (1)..(132): a, c, t, g, unknown or other
  modified_base (235)..(516): a, c, t, g, unknown or other
  modified_base (581)..(583): a, c, t, g, unknown or other
  modified_base (585)..(586): a, c, t, g, unknown or other
  modified_base (588)..(588): a, c, t, g, unknown or other
  modified_base (636)..(636): a, c, t, g, unknown or other
  modified_base (638)..(638): a, c, t, g, unknown or other
  modified_base (654)..(654): a, c, t, g, unknown or other
  modified_base (705)..(705): a, c, t, g, unknown or other
  modified_base (769)..(771): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtgaccacctacaaagtgatcaccaagaaggtgccccgggtggtggccgagcgcaagaagtgggccaaattcgggcagtccaaggacgacggctcgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgacgacagcaccgtgcgcatcaccaacctgcccgaggactcggacgaggaggacctgaagcnnntnntngcccagcagggcaaaatcaaccgaatctacgttgcccgcgacaagacnancaacaagcccaagggnttcgccttcatcaccttctacacgcgcgccgaggcggaggaggccatccgncgcttcaacggggccaagtttgagcatttgatcctgaaggtggagtggacccggccgtcgaacnnn

SEQ ID NO: 722 - DNA, 741 bp, Artificial Sequence
  Description of Artificial Sequence: Synthetic polynucleotide
  modified_base (27)..(27): a, c, t, g, unknown or other
  modified_base (108)..(108): a, c, t, g, unknown or other
  modified_base (267)..(267): a, c, t, g, unknown or other
  modified_base (330)..(330): a, c, t, g, unknown or other
  modified_base (354)..(354): a, c, t, g, unknown or other
  modified_base (357)..(357): a, c, t, g, unknown or other
  modified_base (363)..(363): a, c, t, g, unknown or other
  modified_base (375)..(375): a, c, t, g, unknown or other
  modified_base (378)..(378): a, c, t, g, unknown or other
  modified_base (387)..(387): a, c, t, g, unknown or other
  modified_base (405)..(405): a, c, t, g, unknown or other
  modified_base (411)..(411): a, c, t, g, unknown or other
  modified_base (420)..(420): a, c, t, g, unknown or other
  modified_base (456)..(456): a, c, t, g, unknown or other
  modified_base (465)..(465): a, c, t, g, unknown or other
  modified_base (489)..(489): a, c, t, g, unknown or other
  modified_base (501)..(501): a, c, t, g, unknown or other
  modified_base (510)..(510): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (573)..(573): a, c, t, g, unknown or other
  modified_base (612)..(612): a, c, t, g, unknown or other
  modified_base (621)..(621): a, c, t, g, unknown or other
  modified_base (645)..(645): a, c, t, g, unknown or other
  modified_base (679)..(681): a, c, t, g, unknown or other
  modified_base (684)..(684): a, c, t, g, unknown or other
  modified_base (702)..(702): a, c, t, g, unknown or other
  modified_base (739)..(741): a, c, t, g, unknown or other
atggcacttcgcacccaatttgaagcnagcaacgatgttggagtcttctgcaaacttaccaatgcctattgtctggttggcattggttcgtccgagaacttttacagntttgttgaggccgagctggccgacgtcattcccgtcattcactgcaccatttctggcacccgaattgttggacgcgtcacggtgggcaaccggcatggcctgcttgtgccaaacgccacaaccgaccaggagttgcaacacattcggaacagtctgccngacacagtccagattcgacggatagacgagcggctgtcggcattgggcaatgtggttgcatgnaatgaccatgtggccattgtgcangcngagatnagcaaggagacngancaggcgctngtggaagtgctgaaggtngaggtntttcggctnagcctgggcgagaacacattggtcagcgcatacgcngccctcacntccaatggctgtctggtggctgcnaaaactcctccngaagtgcancgcganttggcntcnctcatccaagtgccggtggttgccggaacgatcaatcggggctccganctcatcggggccggtgtttgtgtgaatgattggattgcnttttgcganctggagacaacttccgccgagctntccgtcctcgagtccatcttcaagttgggcgacnnnaangcgccagcagcgattacnaacaatctgcgggacaccctcattgagtccatgcttnnn

SEQ ID NO: 723 - DNA, 912 bp, Artificial Sequence
  Description of Artificial Sequence: Synthetic polynucleotide
  modified_base (1)..(81): a, c, t, g, unknown or other
  modified_base (124)..(126): a, c, t, g, unknown or other
  modified_base (249)..(249): a, c, t, g, unknown or other
  modified_base (318)..(318): a, c, t, g, unknown or other
  modified_base (336)..(336): a, c, t, g, unknown or other
  modified_base (342)..(342): a, c, t, g, unknown or other
  modified_base (345)..(345): a, c, t, g, unknown or other
  modified_base (390)..(390): a, c, t, g, unknown or other
  modified_base (436)..(436): a, c, t, g, unknown or other
  modified_base (622)..(912): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnncagataaatttgaccattcccggtgccgtcatttgtccggcgnnnatgggcattatgcgcggacatggcacatttgtggaaggggcgaacctgcactcttcattggctggcgttgtgattcaaacaaacaaactagtccgagttaagcccgtcaaaacaaggtaccanggcgaggttggcgacgttgtcgttggccgagtggtcgaggtccaacaaaagcgttggaaagtggatacnaattcccgactccacagngtcctnctnctggccagcgtcaatttgcccggaggcgagctaaggcgcaaatcnatcgaagatgagctggccatgcgcgagtacttgcgagagggcgatntggtcagcgccgaggtgcaacaatgtttccatgacggcgccctctcgttgcagacgcgcagtctgaagtatggcaaacttggccaaggccagctgatcaaggtgctgccccatttggtgcggcgacgcaaagtgcacttccacaatctgccatttggcgcatccgtcattctgggctgcaacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 724 - DNA, 723 bp, Artificial Sequence
  Description of Artificial Sequence: Synthetic polynucleotide
  modified_base (1)..(123): a, c, t, g, unknown or other
  modified_base (328)..(330): a, c, t, g, unknown or other
  modified_base (556)..(723): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttcaggttttctgcgcagtttatggcccacacgagggccggcaccggtcgaaaataaacgaagaggcggccgttgtttgccagtacagccaagccactttctcggtgccagacagacgcaatcggccaaggggcatcggccgggggaatgccagctctcggctgttggaacgcgcctttgagtcggtcattttgaaccagnnntatccgcgcagtcaaatcgacattttcttcgagattattgaggccgacggcggaaaccttgcggcctgcgtgaacgccggcagccttgcactggccgatgccggaatcccaatgcgtggactggccgccgccgtcgagtcgggcagcattgatgggacggcttgcgcggacatgagctccagggagcatagcgagttggtgccgcgcatcacaatggccacagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 725 - DNA, 735 bp, Artificial Sequence
  Description of Artificial Sequence: Synthetic polynucleotide
  modified_base (1)..(93): a, c, t, g, unknown or other
  modified_base (271)..(273): a, c, t, g, unknown or other
  modified_base (397)..(399): a, c, t, g, unknown or other
  modified_base (405)..(405): a, c, t, g, unknown or other
  modified_base (417)..(417): a, c, t, g, unknown or other
  modified_base (441)..(441): a, c, t, g, unknown or other
  modified_base (457)..(457): a, c, t, g, unknown or other
  modified_base (459)..(459): a, c, t, g, unknown or other
  modified_base (473)..(473): a, c, t, g, unknown or other
  modified_base (483)..(483): a, c, t, g, unknown or other
  modified_base (503)..(503): a, c, t, g, unknown or other
  modified_base (506)..(509): a, c, t, g, unknown or other
  modified_base (604)..(609): a, c, t, g, unknown or other
  modified_base (663)..(663): a, c, t, g, unknown or other
  modified_base (733)..(735): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccatctttatttcagacattcccatcagaactaatctatgcatgttatgagcaaggccagcttcattttggtgagaattatttggatgaattggaaaggaaagctgcggaattggctgagcgtgcttcccatattcgatggcattacattggcaggctacaatccaataaggttnnntatttttagaattgtaaaaatatccatttttatgagacagatcaagaaaataaacatttgtgtgtttttattcaaggttttattaaaatatggatgaattttttgagcaaaacatttttagtgnnngtgaanaccagcaatganaagaacaagggcggcgtggagccnaatgaattaccaacantngcaaaacatttganggaaaagtgnccaaaccttaatctgcttgnatnnnngactatcggatcgatggaagaaagcaaaaatcccgaggaaaatgcggactttacccggttaaggaatttacgagatgttctgatggagcaattgnnnnnngactgtgcaagattggagttaagcatgggcatgtcacaggattacccactaccnataaagtatggaagcaccaatgttcgagttggatctacaattttcggccaaagaacttaccctgacaaannn

SEQ ID NO: 726 - DNA, 3246 bp, Artificial Sequence
  Description of Artificial Sequence: Synthetic polynucleotide
  modified_base (1)..(255): a, c, t, g, unknown or other
  modified_base (306)..(306): a, c, t, g, unknown or other
  modified_base (315)..(316): a, c, t, g, unknown or other
  modified_base (324)..(324): a, c, t, g, unknown or other
  modified_base (348)..(348): a, c, t, g, unknown or other
  modified_base (367)..(367): a, c, t, g, unknown or other
  modified_base (372)..(372): a, c, t, g, unknown or other
  modified_base (388)..(879): a, c, t, g, unknown or other
  modified_base (1156)..(1272): a, c, t, g, unknown or other
  modified_base (1599)..(1599): a, c, t, g, unknown or other
  modified_base (1717)..(1719): a, c, t, g, unknown or other
  modified_base (1774)..(1800): a, c, t, g, unknown or other
  modified_base (1945)..(1945): a, c, t, g, unknown or other
  modified_base (1947)..(1947): a, c, t, g, unknown or other
  modified_base (1950)..(1950): a, c, t, g, unknown or other
  modified_base (2026)..(2028): a, c, t, g, unknown or other
  modified_base (2083)..(2097): a, c, t, g, unknown or other
  modified_base (2395)..(2395): a, c, t, g, unknown or other
  modified_base (2397)..(2397): a, c, t, g, unknown or other
  modified_base (2648)..(2650): a, c, t, g, unknown or other
  modified_base (2652)..(2652): a, c, t, g, unknown or other
  modified_base (2700)..(2700): a, c, t, g, unknown or other
  modified_base (2727)..(2727): a, c, t, g, unknown or other
  modified_base (2733)..(2733): a, c, t, g, unknown or other
  modified_base (2736)..(2736): a, c, t, g, unknown or other
  modified_base (2860)..(3057): a, c, t, g, unknown or other
  modified_base (3135)..(3135): a, c, t, g, unknown or other
  modified_base (3238)..(3246): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcgcatgtttggggtgacccgaagcggcaactccatcgcggtttgtgcnaccggctannggccctanttttacgcgtccgcaccgcaaggntttgggcaagagcatgtgnccagngcggttgaggcaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcactttcccggacgccaaccgcgacccagtcatccaaattgccaacatggtcaagttggagggccaaaccgaaccgttcatccgcaactgctttgtgctgggcacctgcgaacccattgtgggctcggacgtgtacgagtgccgcacggaggaggaattgctcaacaaatgggccgactttgtgcgtcgggtggacccagacctgctgaccggatataatatacagaacttcgatttgccctacatcatggaccgggccaaggtgttgaaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattttatttattttttaggtcatcttgcgtgactacaagctgcgcagctacagcctgaacaatgtcagctacttcttcttgggcgaacagaaagaggatgtggcctataacttcattcctgaacttcagaacggaagtccccatgaccggcgtcgtttggccctctactgcatgaaggatgcctacctgccacttcgcctgctggacaaactgatgctgatcatcaactacatggaaatggcccgagtcaccggggtcccgctgaactttctgatcacacgcggacaacaagtcaaaattctgtccatgattttgcgaaaggcntcgtcgcctgaacctcttctgccggtcattgaaactggtgagggcggcgatgagggctacgagggcgcaaccgtgattgaaccaatctgcgacttctacaacgagccaattgccaccnnngattttgcttcgctgtacccgtccatcatgattgcccacaacctgtgctacaccnnnnnnnnnnnnnnnnnnnnnnnnnnngaaggcgcggactacatccgcacaccgtccggcgacctgttcatccaccaaaagcatcgccggggattgctgccccaaattctggaggagctgctggcggccaggaaaaaggccaaggctgacctgaagaaggagaccgacccgntnagncaaatggtgttgaacggtcgtcaaatggccttgaaggtgagcgccaactcggtgtacggcttcacgggtgcctccnnncggaaattgccatgcgttgaaatctcccaatccgtgacggcatttggacgcaaannnnnnnnnnnnnnnaaattactttttccagcattttacacggagggcgcctgcgacggcctgtgcccggtgaacgccaaagtcatctacggggacaccgactcggtgatggtcaaattcggggtgaaaaccgtcgccgaggcaatgctgctgggccggcatgcggcgcaggaaatcagcaagcactttgttcggccaatccagctggagttcgagaaggtctacttcccctacctgctgatcaacaagaagcgctatgccgggctgttttggacgagggaggagaaatttgacaagatggattgcaaagggntngaaacagtccgccgtgacaattgccccctggtggccagtgtgctgaacgtgtgcctcgaaaagctgctcattgaccgagacaagcacggcgcgttaaactacgcaaaagccgtcatttccgacctgctctgtgggaagattgacatctccatgctgaccatcaccaaggagttgaccaagaagggcgagaaatatgccgccaaacaagcccacgtggaattggctgaacgcatgcggaaaagggacccagnnncngccccacgccttggcgaccgagtgccctacgtgatcgtgaacaagggnaccaacgtgccggcctatgagaaggcngaaganccnatttgggtgcttgaacacaacgtcccaattgacaccacctactacctggagcatcaactggtcaagccgctggtgcgcatatttgagccaatccttgggaatcgggccgagaattacttgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaccgttttggacgcctttggaccgaatgccagaattgcgctggaatgctccagggcgaggtgttttgtgcacgncgtgactgcccaatcttctacatgcgtgaaaaggtgcggaatgatttggaggagttggagcgcacattccgtcgattccaagtccagtcgggcgaggcgccgnnnnnnnnn

SEQ ID NO: 727 - DNA, 1653 bp, Artificial Sequence
  Description of Artificial Sequence: Synthetic polynucleotide
  modified_base (1)..(84): a, c, t, g, unknown or other
  modified_base (93)..(93): a, c, t, g, unknown or other
  modified_base (102)..(102): a, c, t, g, unknown or other
  modified_base (120)..(120): a, c, t, g, unknown or other
  modified_base (126)..(129): a, c, t, g, unknown or other
  modified_base (180)..(180): a, c, t, g, unknown or other
  modified_base (385)..(387): a, c, t, g, unknown or other
  modified_base (603)..(603): a, c, t, g, unknown or other
  modified_base (688)..(771): a, c, t, g, unknown or other
  modified_base (886)..(954): a, c, t, g, unknown or other
  modified_base (967)..(968): a, c, t, g, unknown or other
  modified_base (1227)..(1227): a, c, t, g, unknown or other
  modified_base (1243)..(1245): a, c, t, g, unknown or other
  modified_base (1417)..(1653): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnncggtttgtntatggcacngcaggctttcgagcggangcaaannnnctggaggaagttgttcgtcggactgcattttatgctgccatccgagcaagnaccttgggcaaatccatgggcctgatgatcaccgcttcccacaatcccgccaaggacaacggcatcaagctggtcgaccccagtggccgaatgctgcccatggagtgcgagtgccaattgacggatttggtgaacacatccgcggaggaattcgactaccggacaaaagcattggctgaaccggttggacttgcggaagttcagnnncccgccgtggtcattgccactgacacgcgcccatcgtcgaaagcactctttcacgctgccatcgagggaattcaaggcacgggtgttcgcgtggaaccattcggttatttttaaattaaattaaaattttatttatattttaatttttaagagcaccacacaaccccgcagctccacttcattgtgcgcgccataaatgacaaaaacttctcgtcnaattttcagttaattccattcgatccctccagtgactacaccaagcaattgtttgttgactgcgccaatggggtgggcgcccccnnnnnnnnnnnnnnnnnnnnnnnnnnnnnnnnnnnnnnnnnnnnnnnnnnnnnnnnnnnnnnnnnnnnnnnnnnnnnnnnnnnntgtggcgccgattttgtgaaaatccacgcccaattgcccgccaactttgccggggtgccggtgggtgctcgttgcgcatcccttgatggagacgcagaccgacttgtttatttcnnnnnnnnnnnnnnnnnnnnnnnnnnnnnnnnnnnnnnnnnnnnnnnnnnnnnnnnnnnnnnnnnnnnntttataaaaattnntgttttgcagcaattcaaagaagctgaacggctcggccaaccaattcctctcacatttggcgttgtccaaactgcctatgcaaacggcaattcaacgagcttctttcaagaacaattggggctgaaaccggtgttggccaaaacgggcgtgaaacacttggaagaggctgcccatcgtttcgacattggcctctactttgaagcaaatggccacggaacatgctgcttcagcgacaagttccacacattcatggctgangcccaattccccaaannncacattcgtttgctggccctgttctcggcactggtgaacgatgtggtgggcgacgggattgccgacttgctggccgtggagtgcttgctccgccactttggctggtccattcaacaatgggagcagcaaacttatgcgaacatgccgaacgtgcagctgaaagtgacggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 728 - DNA, 1491 bp, Artificial Sequence
  Description of Artificial Sequence: Synthetic polynucleotide
  modified_base (12)..(12): a, c, t, g, unknown or other
  modified_base (261)..(261): a, c, t, g, unknown or other
  modified_base (486)..(486): a, c, t, g, unknown or other
  modified_base (786)..(786): a, c, t, g, unknown or other
  modified_base (975)..(975): a, c, t, g, unknown or other
  modified_base (1158)..(1158): a, c, t, g, unknown or other
  modified_base (1330)..(1335): a, c, t, g, unknown or other
  modified_base (1420)..(1491): a, c, t, g, unknown or other
atggtgttggcngatcttggcagacgtattcggaatgcaattggaaaacttggccaagcaaccgtgatcaatgaggaagagcttgcagcgatgttaaaggaggtttgctccgccctgattgaatcggatgtcaatgtcctactcgtgaagcaattgagagatagcgtgaggaaatcaatcgattttgacgaaatggctggtggtgtgaacaaacggcgcctaatccaaagagcggtctttacagagctgcttaaacttgcngatcctggagtgtctccctaccaaccagttaaggggcgtccaaacattgtgatgtttgttggtctccaaggtgctggaaagacgacaacatgtacaaagatggcctattactatcagaaaaaaggttggaagacttgccttgtttgtgctgatacattccgtgccggcgcattcgaccaactgaagcaaaatgcaacaaaggcaaggattcccttttatggcagntataccgaaattgacccagtgttgattgccgcaaacggtgtggaaaagttcaaaagtgacggcttcgaaatgatcattgtggacacctcgggaagacacaaacaagaagcggcgctttttgaagaaatgctccaagtttcgaacgcaattgaaacccgataatgcgtttttgtcatggacgcttccatcggccaggcttgtgaggcacaggcacgcgcattcaagcagagtgtggacgttgggtcggttatcatcaccaagttggatggacatgccaagggcggaggcgctctctcggcngtggccgccacacgttcgcccattattttcatcggtacgggcgaacacatcgatgattttgaactgttcaaagtgaagcctttcctgcagaagctgcttggcatgggtgatatccagggattggttgaaaaagtctcggaaatgggcctagaagacaacgaggagttaataaaaagactgaaacaagcncaattcaccctgcgtgacatgtacgaacaattccagaacatcatgaagatgggtcccttcgggcagattatgagtatgatcccgggcttcgggtcggacttcctgtccaaaggaaacgaacaggaatcacagtccagactgaagaaattgatgacaatcatggattccatggcagatagcgancttgaccatcacaaagccaatgatctgttcactaaagaaccaggcagactgactcgtgtggcgaaaggaagtggcacatccgtgaacgaagtcaaagaattgctctcccaatacaagaagtttgcggacatggtcaagaagatgggcagtatgaagggtcttttcaagggannnnnnaatgaaatgaacccgaagaatatcaaccccggccagatggcaaagttgaatcagcaaatggccaaaataatggacccccgggtgnnnnnnnnnnnnnnnnnnnnnnnnnnnnnnnnnnnnnnnnnnnnnnnnnnnnnnnnnnnnnnnnnnnnnnnn

SEQ ID NO: 729 - DNA, 618 bp, Artificial Sequence
  Description of Artificial Sequence: Synthetic polynucleotide
  modified_base (1)..(36): a, c, t, g, unknown or other
  modified_base (252)..(252): a, c, t, g, unknown or other
  modified_base (280)..(280): a, c, t, g, unknown or other
  modified_base (282)..(282): a, c, t, g, unknown or other
  modified_base (284)..(291): a, c, t, g, unknown or other
  modified_base (399)..(399): a, c, t, g, unknown or other
  modified_base (417)..(417): a, c, t, g, unknown or other
  modified_base (465)..(465): a, c, t, g, unknown or other
  modified_base (579)..(579): a, c, t, g, unknown or other
  modified_base (600)..(600): a, c, t, g, unknown or other
  modified_base (610)..(618): a, c, t, g, unknown or other
nnnnnnnnnnnnnnnnnnnnnnnnnnnnnnnnnnnncatcttttcaatctccggtttgcggccaaagaattgtccaggaatgcgaagaaaagcgagaagcaagagaaggaagaaaaagtcaaactcacgaatgcacttaagaaaggaaatcgagaggtggcgcaagtccatgcagaaaatgcgatcaggaagaagaatgagtcactgaactatttgaggatgtcggcacggattgatgcggttgcagcccgngttcaaaccgcagcaacacagaaacggntnannnnnnnnatctcatcagtggtgaaagcaatggaatcggcgatgaagtcaatgaatttggagaaagtgcaaaatctgatggaccgcttcgagaaggactttgaagatttggacgtncaatcggccacaatgganggatccatgaacgcgaccaccacgctgaatgcaccccgccatgaggtngacgctttgatccaagaagctgctgacaaagctgggttggagcttggaatggaaatgcccgccgcccaagtggaagcacccggcggtgcgcgcacagcggttaccgacaacgangagctttccaaacgactggcngcactcagannnnnnnnn

SEQ ID NO: 730 - DNA, 1209 bp, Artificial Sequence
  Description of Artificial Sequence: Synthetic polynucleotide
  modified_base (1)..(75): a, c, t, g, unknown or other
  modified_base (160)..(162): a, c, t, g, unknown or other
  modified_base (261)..(261): a, c, t, g, unknown or other
  modified_base (414)..(414): a, c, t, g, unknown or other
  modified_base (420)..(420): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (459)..(459): a, c, t, g, unknown or other
  modified_base (540)..(540): a, c, t, g, unknown or other
  modified_base (591)..(591): a, c, t, g, unknown or other
  modified_base (612)..(612): a, c, t, g, unknown or other
  modified_base (623)..(623): a, c, t, g, unknown or other
  modified_base (684)..(684): a, c, t, g, unknown or other
  modified_base (726)..(726): a, c, t, g, unknown or other
  modified_base (729)..(729): a, c, t, g, unknown or other
  modified_base (736)..(736): a, c, t, g, unknown or other
  modified_base (780)..(780): a, c, t, g, unknown or other
  modified_base (891)..(891): a, c, t, g, unknown or other
  modified_base (900)..(900): a, c, t, g, unknown or other
  modified_base (918)..(918): a, c, t, g, unknown or other
  modified_base (942)..(942): a, c, t, g, unknown or other
  modified_base (963)..(963): a, c, t, g, unknown or other
  modified_base (966)..(966): a, c, t, g, unknown or other
  modified_base (969)..(969): a, c, t, g, unknown or other
  modified_base (972)..(972): a, c, t, g, unknown or other
  modified_base (975)..(975): a, c, t, g, unknown or other
  modified_base (990)..(990): a, c, t, g, unknown or other
  modified_base (993)..(993): a, c, t, g, unknown or other
  modified_base (999)..(999): a, c, t, g, unknown or other
  modified_base (1044)..(1044): a, c, t, g, unknown or other
  modified_base (1053)..(1053): a, c, t, g, unknown or other
  modified_base (1077)..(1077): a, c, t, g, unknown or other
  modified_base (1080)..(1080): a, c, t, g, unknown or other
  modified_base (1104)..(1104): a, c, t, g, unknown or other
  modified_base (1201)..(1209): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnaaagcgacttgtctccacgacttccatgtgcggaatggcgcaaaaatggtggagtttgccggcttctccatgcccggccaatacnnngatctctctgtgagcgagtccacaaagcataccaggtcggaagtgagcctgtttgatgtgtcgcacatgatgcaggtttaaatttcaattttgaaaaangaagctttcattgagtctctcacgccggcggatgtgcagcaaatgccagtaaacacaggcacattgagtgttttcacaaatgcaaaaggaggagtcattgatgatttgataatcacaaaaacttcggacgacacactctttttggtcacaaangctggncgnattgacgcnganttggcgcatcttcagaaaaacgcngaaaattggcgtcaacaaggcaaagacgttcaaattgaagttttggaaaatcgtgccttgattgcagttcaagttccaaanatggcaaaattgctccaagagcaaaccgacattccactggaatccctcttnttcatgcacacttccactggncgggtttgtgncgttccaaactgtcgggtgaccagatgcgggtacacgggcgaggatggagtcgagatttcngtgccatcaaaagacgcagaaaccgtcgtgcaaagactgctngantccaaancagtttccacaaaaatggccggcctggctgtgcgcgatgtgctncgaactgaagcgggcctatgcctctatgggaacgagttgaacgaggaaaccaccccggttgaggcggggattgcctttgtgattgataagagaagacgccaaactttgggntttcccggngccgagaagatcatggancagttggagaagaaaaatgcgccnaaaaagcgggttggacttgtngcnaanggnggnagggcgccaagagcncanatgccnatcgtgaaccgcatggacaagggcgccatcgggttcgtcacgtcnggctgcccntcgccatgcctgggcaaaaacatngcnatggcctatgtggacacggattgngcaaaaaatggggccctccatgacgtggacacgggcgccaagctgtgcgaggtggaggtggtgaaaatgccttttgttaagacaaagtattacaccnnnnnnnnn

SEQ ID NO: 731 - DNA, 1389 bp, Artificial Sequence
  Description of Artificial Sequence: Synthetic polynucleotide
  modified_base (1)..(231): a, c, t, g, unknown or other
  modified_base (267)..(267): a, c, t, g, unknown or other
  modified_base (273)..(273): a, c, t, g, unknown or other
  modified_base (279)..(279): a, c, t, g, unknown or other
  modified_base (372)..(372): a, c, t, g, unknown or other
  modified_base (412)..(412): a, c, t, g, unknown or other
  modified_base (415)..(415): a, c, t, g, unknown or other
  modified_base (432)..(432): a, c, t, g, unknown or other
  modified_base (447)..(447): a, c, t, g, unknown or other
  modified_base (450)..(450): a, c, t, g, unknown or other
  modified_base (459)..(459): a, c, t, g, unknown or other
  modified_base (472)..(472): a, c, t, g, unknown or other
  modified_base (480)..(480): a, c, t, g, unknown or other
  modified_base (483)..(483): a, c, t, g, unknown or other
  modified_base (492)..(492): a, c, t, g, unknown or other
  modified_base (532)..(903): a, c, t, g, unknown or other
  modified_base (927)..(927): a, c, t, g, unknown or other
  modified_base (932)..(932): a, c, t, g, unknown or other
  modified_base (937)..(937): a, c, t, g, unknown or other
  modified_base (984)..(984): a, c, t, g, unknown or other
  modified_base (1005)..(1005): a, c, t, g, unknown or other
  modified_base (1023)..(1023): a, c, t, g, unknown or other
  modified_base (1041)..(1041): a, c, t, g, unknown or other
  modified_base (1053)..(1053): a, c, t, g, unknown or other
  modified_base (1122)..(1122): a, c, t, g, unknown or other
  modified_base (1161)..(1161): a, c, t, g, unknown or other
  modified_base (1197)..(1197): a, c, t, g, unknown or other
  modified_base (1203)..(1203): a, c, t, g, unknown or other
  modified_base (1209)..(1209): a, c, t, g, unknown or other
  modified_base (1246)..(1389): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatcgatcccaacacaattggctttttggcggtnggaacngaaacnttggtggacagaagcaaaagcataaagtctgtgttgatggatttgttctccgggaacaccgacatcgagggaattgatgagaaaaatgcctgntttggtgggacacaagcactcttccatgccgttgattggnttnattcaaattacaagttngagaagagatcagcnatngtggtgtgngtggacattgccntttatgcncanggaccagancgatgcactggcggtgctggtgcgattgccttcctcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcgctgaaggcaagtggtgtngaagncgagnaaaagttgaacccacaccttgtttttggccgtcgaataggcaacatntacactccatctctttatgcncaactgttgttttacaanacaaaattttcacaaganatgcacaaacancggattttgatgttttcctacggcagcggatgtgttgcagcactttattccctgactttgaatcaagcnggatcctatgcattgataaagcagagtgcggaaagggcntttgaacgactggatgccagagtcaagtatgcgccngaacanttcacnaaaattttgggggctcgagaacggatcatccagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 732 - DNA, 462 bp, Artificial Sequence
  Description of Artificial Sequence: Synthetic polynucleotide
  modified_base (198)..(198): a, c, t, g, unknown or other
  modified_base (201)..(201): a, c, t, g, unknown or other
  modified_base (239)..(239): a, c, t, g, unknown or other
  modified_base (243)..(243): a, c, t, g, unknown or other
  modified_base (267)..(267): a, c, t, g, unknown or other
  modified_base (279)..(279): a, c, t, g, unknown or other
  modified_base (303)..(303): a, c, t, g, unknown or other
  modified_base (342)..(342): a, c, t, g, unknown or other
  modified_base (370)..(462): a, c, t, g, unknown or other
ctggaaaatcgagaacgcacatttattgctgtgaagcctgacggtgtgcaacggggaattgtcaacaaaattatgaagcaattcgaacaacgcggttacaaactggtggccattaagatggtgcaggcaagtcgtcagcatttggaggtacattaccaagacctgaagagtaagcctttcttcccgggacttgttgantanatggcctccggaccggttgtggctatggtttgggaagntctngatgtcgtgaagcagggacgtgcnatgcttggcgcnaccaatccgctgagcagcgcaccngggacaattcgcgggagttattgcatcgagactggacgnaacatctgccacgggtctgacagcgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 733 - DNA, 894 bp, Artificial Sequence
  Description of Artificial Sequence: Synthetic polynucleotide
  modified_base (1)..(441): a, c, t, g, unknown or other
  modified_base (558)..(558): a, c, t, g, unknown or other
  modified_base (790)..(894): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgggacgtgcacatcatggctcaacccttgaaaaatttgtggaccaccgaagagataatatatttgactgctgattccgaaaatctgcttgaaactctggatgaagaaaagttntatgtcattggcggcttgctcgaccacaaccaccataaaggaatttgtttgaagaaggccaaggagaatggctttggtcacgcccgtttgcccatcgattcctttttccggatgagtggacgcaaagtgctgaccatcaaccaagttttccaaattctggtcaattattcacaggaatcgaattgggagaaggccttcttggatgtcattccgaagcgcaaagggattgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 734 - DNA, 999 bp, Artificial Sequence
  Description of Artificial Sequence: Synthetic polynucleotide
  modified_base (1)..(54): a, c, t, g, unknown or other
  modified_base (381)..(381): a, c, t, g, unknown or other
  modified_base (402)..(402): a, c, t, g, unknown or other
  modified_base (432)..(432): a, c, t, g, unknown or other
  modified_base (456)..(456): a, c, t, g, unknown or other
  modified_base (475)..(561): a, c, t, g, unknown or other
  modified_base (660)..(660): a, c, t, g, unknown or other
  modified_base (765)..(765): a, c, t, g, unknown or other
  modified_base (774)..(774): a, c, t, g, unknown or other
  modified_base (780)..(780): a, c, t, g, unknown or other
  modified_base (825)..(825): a, c, t, g, unknown or other
  modified_base (828)..(828): a, c, t, g, unknown or other
  modified_base (834)..(834): a, c, t, g, unknown or other
  modified_base (891)..(891): a, c, t, g, unknown or other
  modified_base (897)..(897): a, c, t, g, unknown or other
  modified_base (994)..(999): a, c, t, g, unknown or other
nnnnnnnnnnnnnnnnnnnnnnnnnnnnnnnnnnnnnnnnnnnnnnnnnnnnnncgttttgctagcacgctcattttggctgaacataatgatgagaagctgaatgccctaaccctgaacgcagttacggccgccaaaaaaattggtcatgaaattagcatgttggtgacagggaagaatgcagaaacagtcgcaaagtcggcatcgaaaatagctgatgttaagcgtgttttatttgcgcaaaatccaaaattagaggcaaatttaccagagagggtctcttctgtccttttggcagttcaaaagcaattcaatttcacgcatatactcgccggtgcttcttcattcagccgtggtgtgataccacggactgcggcgctnctggatgtttcgccaatttcngaaattaccacggttcacagtgaagacacnttctcgaggccaacctacgccggnaatgcgattgccaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccggatgtggaaattagcactgaactcagcgaattcctgggccaagaattgagcaaatccgagcgacccgaactttccggagccaaaattgtcatntccggtgggcgtggactcaaatcgggcgagaatttcaaaattctctacgatcttgctgatttgctcggcgctgccgttggtgccagccgtgcggccgtggatgcnggttatgtncccaangacatgcaagtgggacagactggaaagattgtggctccgcaactntanattgcngtcggaataagtggagcaattcagcatctggctggtatgaaggacagcaagctgatngttgcnatcaacaaggacaaggacgcgcccatcttccaggtcgccgattttggacttgttgctgatttgttcaaagcagtgccggaaatgaccgaggagctcnnnnnn

SEQ ID NO: 735 - DNA, 1743 bp, Artificial Sequence
  Description of Artificial Sequence: Synthetic polynucleotide
  modified_base (1)..(480): a, c, t, g, unknown or other
  modified_base (499)..(501): a, c, t, g, unknown or other
  modified_base (648)..(648): a, c, t, g, unknown or other
  modified_base (799)..(843): a, c, t, g, unknown or other
  modified_base (901)..(903): a, c, t, g, unknown or other
  modified_base (1096)..(1182): a, c, t, g, unknown or other
  modified_base (1552)..(1743): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactttgaattggatctgnnncgttttggaccttaccggctaaattacacccaaaatggacgtcatttgctgttgggcggtcgcaaaggccatattgctgcgttcgattggatgacaaaggacttgatgggtgaaatcaatgtgatggaaacagttcgcgatgtccantggcttcatttggagacaatgtatgccgtggcacaaaagcggtggttacgcatctatgacgggctgggaactgaattgcattgcatcaaaggaatgtttgatatccgtcgactggaatatctgccaaggcactttctacttgtcggatcgnnnnnnnnnnnnnnnnnnnnnnnnnnnnnnnnnnnnnnnnnnnnnaaggtcgcttcatttcccactggccatggcccacttgaagttatcacacaaaatccgnnnaatgccataattataagcggtgattcgcgcggcacagtctcaatgtggtcaccaaatagcaaaaagcccctcgtggaaatgctagcacacaaaagtactgtcctgggtgtggctgttgatcaaagtggcacttatatggcaaccaccggtcttgataatcgcatgcgtctttgggatttgcgcaattataagnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagattttcaacaaagcccatcaaggacaggcaagccgaccgtatcttaaacatctctgccccggtctgatcacggatctccaattctgtccctatgaagatgtgcttggtgttggccataccaaaggtgtggtcagcttgttagtgcccggctctggtcaatccaattttgatgcgcttcgtgcaaatccattcgagtcaaagaaacagcgaaaggagcgtgaagtgcggatgcttttggataagatccagccagagatgatcacattgaatccaggcgacataaaccaagtgaacaagaaggggctgaaagacacactagaatataaatcaaataaactctacatcaagccaacccaaattgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 736 - DNA, 1776 bp, Artificial Sequence
  Description of Artificial Sequence: Synthetic polynucleotide
  modified_base (1)..(351): a, c, t, g, unknown or other
  modified_base (547)..(549): a, c, t, g, unknown or other
  modified_base (672)..(672): a, c, t, g, unknown or other
  modified_base (787)..(789): a, c, t, g, unknown or other
  modified_base (928)..(1152): a, c, t, g, unknown or other
  modified_base (1206)..(1206): a, c, t, g, unknown or other
  modified_base (1258)..(1341): a, c, t, g, unknown or other
  modified_base (1402)..(1500): a, c, t, g, unknown or other
  modified_base (1666)..(1776): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgaaccaaagcttgattgagatggtgcaacatgttctctccactgacgcattctattattcacttcaaatggacctatcacatacattccaatggctcagtgaaaattccaccccagacttacatcaacaaccattgctacagagagtggaccaacggtttgtgtggaatgcaaaattatgtgcaaaattcnnnaacacgcccgagctatccaaatttgtccatcctctaatccatggctttgttggcattcggcactgcagcgttaatcatattccattcaaattagcaatcatttcacggagatctgtggaaagngctggcgtccgtttccatacacgtggtgctgatacggaagggaattgtgcaaattttgttgaaaccgaacagattgtccaatatgatgcagacactatgcatgttttttcttatnnncagatgcgcggctcaatgcccttatattggtcgcaaaaacccaatctcaagtggcagccggatccaagtgttagaatagtggaagaacaatacgattgtttcaaacaacatttaagcactcttttccaccattatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgaagataatcggctctatcaaaacggtttcttccgcacaaattgcatgtantgtcttgacagaacaaatgtagtgcaagcactgctagggatggaatcacttnnnnnnnnnnnnnnnnnnnnnnnnnnnnnnnnnnnnnnnnnnnnnnnnnnnnnnnnnnnnnnnnnnnnnnnnnnnnnnnnnnnngtatgggcggataatggtgatgactgcagcaaacaatatgctgggacaggagctttgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcaaaggacgccataaaccttttccttggcaattatgttgtagaaaaagaaacactcccagaatgcgttgatcattctttggtcaatttcgatgcaaatggattcgccatagggggcgccatattctcggcagcaatgaccttgctatgcgttttagtatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 737 - DNA, 3003 bp, Artificial Sequence
  Description of Artificial Sequence: Synthetic polynucleotide
  modified_base (415)..(415): a, c, t, g, unknown or other
  modified_base (786)..(786): a, c, t, g, unknown or other
  modified_base (1551)..(1551): a, c, t, g, unknown or other
  modified_base (2135)..(2136): a, c, t, g, unknown or other
  modified_base (2434)..(3003): a, c, t, g, unknown or other
atgccacttcgtttggatgttaaaagaaaattattggcacggtcagaccgtgtgaaatgcgttgaccttcacccaaatgaaccatggacccttgtatcgttgtacaatggacatgtccatatttggaatcatgaaacccaacaattggttaaatcctttgaggtgtgcgaacttcccgtacgagctgcgaaattcattgtgcgcaaaaattggattgccactggttcggatgatatgcaactgcggattttcaattacaatacactggagcgtgttcatcaaatggaagcccactctgattatttgcgctcaattgctgtccatccaacgcaaccatttttgcttaccagttcggatgatatgcttatcaaactgtgggattgggaagataaatggaaactgaagcagacatttnaaggtcatacgcattatgtgatgcaattggtgatcaacccaaaagacaacaatacctttgcgaccgcatctctggacaaaacaatcaaagtttggcaattcggaagctcagtgcccaactttacactagaaggtcatgagaaaggggtgaatgcggtggattattaccatggcggtgacaagccatatctcatttcgggtgcggatgatcgactcatcaaaatttgggactaccaaaacaaagcttgtgtagccactctggacggtcatgcgcataatgtgtcggctgtgtgcttccaccccgagctacccattattataactgggtcggaagattccaccgtgcgtatttggcatgccaacacaaatagnttggaaacaaccctgaattatggcctagaacgtgtctggtgcatcacagctcagaaaggctcaaatacggttgcgatcggatacgatgagggatctgtcacaatcaaaattggacgtgaagagccggctgtttccatggatgccactgggaaggtgctgtgggccaagcacactgatgtgcagcaggcaaatttgaaaacaatcgacgaacaaacacttgaatcggcacaagatggtgaacgactgactcttgcagtcaaagacatgggctccaccgaggtgtacccgcaaaaagttcaacattcgccaaatggacgctttgttgttgtgtgcggagatggcgaatacattatctacacggccactgctctccggaacaaatcttttggatccggcttggactttgcttgggcaaacgactccaacatatacgcggtgcaagagacttcacaaatgatcaaattgttcaagaacttcaaggaaattcttcaagtgcgtcccgatatcacactcgaagggcttgatgggggacatctgcttgcagcccgatccgctggctccctcattttctacgattgggaaaccggccatgtgattcgtcgaattgagattgcggcaaagcgcattttctggagcgagaacggcgacatggtggccattgcgggagaagagtcgctctatgtgctcaaatacaatgccgaagctgtggccaacgccaatgacattgggccggatggaattgaagaggcatttgaagtgattgangaattgaatgagtctgtgaaaaccggtttctggattggatattgcttcatcttcacaacaactctgaacagactcagctattatgtgggcggagaattggtcacaattgcgcacatggacaggcccctctatttgctcggctatatggccaaagaaaatcggttgttcgcttgcgacaaggatcacaacattgtttcctacaaactgcttctttccgtacttgagtaccaaacagcggtgatgcgccgtgactttgacactgccgaccgcattctgaagacgattcccgagagtcaatgcacacgggttgcgcaattcttggaaaaacaaggcttcaaaaagcaggcattggccgtaagcaaagatccacagcaccgatttgaactggcactctctctgggcgatttgcgtgccgcttatgagatggcccagcaagcggacagtgaagaaaaatggaagcaattggcgcatgcagcaacaatcaaatcggagttgagattggctggcgaatgcttggccaaagccagggactttggaggccttttgttgctcgcttcttgcgctggatccagccgattggtttnncaactggccaacgagtcgtacagtcacggacagcataatgtttctttcctgtcaagtttcctgcttggcgacatccaaaagtgcatggacattttggtggagaatgggcgaatcccggaagccaccttctttgcgcacacctacgcgcccagtcaagtgccacggcttgtctccctgtggcgggaagcggccagccaatcgttgagtgggattagcaaacgggtcggcgagagtttggcagatccagtcaagtatgagaaccttttcccgggctttgctgaagcacttaaaatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 738 - DNA, 1209 bp, Artificial Sequence
  Description of Artificial Sequence: Synthetic polynucleotide
  modified_base (1)..(117): a, c, t, g, unknown or other
  modified_base (306)..(306): a, c, t, g, unknown or other
  modified_base (423)..(423): a, c, t, g, unknown or other
  modified_base (661)..(738): a, c, t, g, unknown or other
  modified_base (976)..(1209): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccttgttgttggtgcaggaggactgggttgtccggttgccatgtatttgagcgccgcaggcaccggaaaaattggaattgtcgaccatgatacggtatccgtagataatttacatcgacaaattgcacacgacgagggccatttaggagaaccaaaagtggaatcattgaaggcggctttgttgagnattaacagcaaaattgaagtgattgaccataatttcttgctatcaaataaaaatgcactccaaattttctgcgactatgatattgttgccgactgttcagacaatgttgcaacgagntatttgatcaatgatgcatgtgttcttactggaaagcccttagtatcaggaagtgcgctcggttgggaaggccaattgacagtgtacaataatggcccaaaatgcccatgctacagatgcattttcccagaaccacccagtccagaaatggtcaccagctgctcagagggtggtgtccttggcccagtggtcggcgtcatcggcagcatgcaagcgctggaagttataaaaattgccnnnnnnnnnnnnnnnnnnnnnnnnnnnnnnnnnnnnnnnnnnnnnnnnnnnnnnnnnnnnnnnnnnnnnnnnnnnnnnagggagaaaatggctggatgcgcaatctgcagcgaatacccgagaatcacagagttgcaggattatgagaaattctgtggtgcaagtcccactgacaaagtgcgctctctggaaatattgccaacagaacaacgagtcactccagcggagtttggcaagcaattcagacacgctaagactgttcttttggatgtgcgaccatctaccgaatttgaaatctgtcatctacctgaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 739 - DNA, 2109 bp, Artificial Sequence
  Description of Artificial Sequence: Synthetic polynucleotide
  modified_base (1)..(447): a, c, t, g, unknown or other
  modified_base (583)..(583): a, c, t, g, unknown or other
  modified_base (585)..(585): a, c, t, g, unknown or other
  modified_base (588)..(589): a, c, t, g, unknown or other
  modified_base (591)..(593): a, c, t, g, unknown or other
  modified_base (750)..(750): a, c, t, g, unknown or other
  modified_base (777)..(778): a, c, t, g, unknown or other
  modified_base (780)..(780): a, c, t, g, unknown or other
  modified_base (821)..(822): a, c, t, g, unknown or other
  modified_base (824)..(824): a, c, t, g, unknown or other
  modified_base (826)..(826): a, c, t, g, unknown or other
  modified_base (828)..(828): a, c, t, g, unknown or other
  modified_base (830)..(831): a, c, t, g, unknown or other
  modified_base (833)..(836): a, c, t, g, unknown or other
  modified_base (838)..(838): a, c, t, g, unknown or other
  modified_base (889)..(891): a, c, t, g, unknown or other
  modified_base (1189)..(1623): a, c, t, g, unknown or other
  modified_base (1828)..(1830): a, c, t, g, unknown or other
  modified_base (1912)..(1914): a, c, t, g, unknown or other
  modified_base (2001)..(2001): a, c, t, g, unknown or other
  modified_base (2107)..(2109): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgaactgagcaaccgcgcaccgattgtgaccatcatgggccatgtggaccacgggaagaccacactgctcgatgccttgcgccgttctaacatcgtggcccaagagtttggtggcataacccaacacattggcncnttnncnnnaaaattgcctgacattgggaatgtgacatttctggacacgcccggacattctgcatttaaagcaatgcgcgaacgcggcgcccgtgcaaccgacattgttgtgctggttgtggcagccgatgacagtgtgatggagcagacagtggaatccatcggntacgcccgtgaggctggagtgccaatnntngtggccataaacaagtgcgacaagccgggcatcaacaccgnnantntncnncnnnntntgctccatcatggaattgttcccgagcagtttggaggcgaccttggttgtnnncagatatcggccctgcatgggcaaggcattgacaaactgcaggaagcaattctgctccaagccgaaatgatgaacctgcaatccacagcagaaggcccggtagagggaacaatcatcgagtcgagcaatgtccaagggctgggcaacgtttgcaccctgattgtgaaccggggaacgctgcgccggggcactgtgctggtggcgggcacaacttggggacgggtgcgcacaatgcacaacgagttcaatgcgcaagtgcaggaggcgggcccaagcagtccagtccgcatatcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccacataatggcattcaattcgtcagtcaattatcgaatacaggagttggccaagcagaaaaacgtccccttggagcagttccacgtgatttacaaactggtggaacggttgaaggaactgctgaatgcgaagttgacgccattgacggaacgccgtttgctgggcgctggcacagtcatccacgagtacagactggcggatnnnggtcaaaagcggcagccggtggccggcattcgtgtggattggggaacaatggagaggagtggcacttggcgatttgtgcgannntcagaaggcattggaagtggtgcggaggaggcggagaaaaagggtgggcggaatggtggcaaaatattgtaaaattccaaatttgtngttgccgtgaatgacaagaatgtccgctacaaggaagacgaccaagtggaggtgtacgaggatgttgttgtgccccaagaaatacggtggaatccacccggctttnnn

SEQ ID NO: 740 - DNA, 1917 bp, Artificial Sequence
  Description of Artificial Sequence: Synthetic polynucleotide
  modified_base (1)..(123): a, c, t, g, unknown or other
  modified_base (201)..(201): a, c, t, g, unknown or other
  modified_base (463)..(465): a, c, t, g, unknown or other
  modified_base (585)..(585): a, c, t, g, unknown or other
  modified_base (1033)..(1033): a, c, t, g, unknown or other
  modified_base (1036)..(1036): a, c, t, g, unknown or other
  modified_base (1038)..(1038): a, c, t, g, unknown or other
  modified_base (1040)..(1041): a, c, t, g, unknown or other
  modified_base (1043)..(1043): a, c, t, g, unknown or other
  modified_base (1046)..(1046): a, c, t, g, unknown or other
  modified_base (1051)..(1054): a, c, t, g, unknown or other
  modified_base (1056)..(1059): a, c, t, g, unknown or other
  modified_base (1063)..(1063): a, c, t, g, unknown or other
  modified_base (1065)..(1065): a, c, t, g, unknown or other
  modified_base (1069)..(1069): a, c, t, g, unknown or other
  modified_base (1072)..(1072): a, c, t, g, unknown or other
  modified_base (1077)..(1077): a, c, t, g, unknown or other
  modified_base (1079)..(1081): a, c, t, g, unknown or other
  modified_base (1083)..(1083): a, c, t, g, unknown or other
  modified_base (1086)..(1087): a, c, t, g, unknown or other
  modified_base (1089)..(1092): a, c, t, g, unknown or other
  modified_base (1098)..(1098): a, c, t, g, unknown or other
  modified_base (1102)..(1102): a, c, t, g, unknown or other
  modified_base (1104)..(1105): a, c, t, g, unknown or other
  modified_base (1108)..(1109): a, c, t, g, unknown or other
  modified_base (1111)..(1111): a, c, t, g, unknown or other
  modified_base (1113)..(1119): a, c, t, g, unknown or other
  modified_base (1122)..(1122): a, c, t, g, unknown or other
  modified_base (1134)..(1134): a, c, t, g, unknown or other
  modified_base (1137)..(1137): a, c, t, g, unknown or other
  modified_base (1140)..(1140): a, c, t, g, unknown or other
  modified_base (1149)..(1149): a, c, t, g, unknown or other
  modified_base (1152)..(1152): a, c, t, g, unknown or other
  modified_base (1158)..(1158): a, c, t, g, unknown or other
  modified_base (1164)..(1164): a, c, t, g, unknown or other
  modified_base (1167)..(1167): a, c, t, g, unknown or other
  modified_base (1170)..(1170): a, c, t, g, unknown or other
  modified_base (1173)..(1173): a, c, t, g, unknown or other
  modified_base (1176)..(1176): a, c, t, g, unknown or other
  modified_base (1179)..(1180): a, c, t, g, unknown or other
  modified_base (1182)..(1182): a, c, t, g, unknown or other
  modified_base (1185)..(1185): a, c, t, g, unknown or other
  modified_base (1192)..(1194): a, c, t, g, unknown or other
  modified_base (1197)..(1197): a, c, t, g, unknown or other
  modified_base (1200)..(1200): a, c, t, g, unknown or other
  modified_base (1203)..(1204): a, c, t, g, unknown or other
  modified_base (1206)..(1212): a, c, t, g, unknown or other
  modified_base (1215)..(1215): a, c, t, g, unknown or other
  modified_base (1222)..(1338): a, c, t, g, unknown or other
  modified_base (1437)..(1437): a, c, t, g, unknown or other
  modified_base (1445)..(1445): a, c, t, g, unknown or other
  modified_base (1455)..(1455): a, c, t, g, unknown or other
  modified_base (1463)..(1463): a, c, t, g, unknown or other
  modified_base (1468)..(1468): a, c, t, g, unknown or other
  modified_base (1503)..(1503): a, c, t, g, unknown or other
  modified_base (1527)..(1527): a, c, t, g, unknown or other
  modified_base (1540)..(1917): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattgcttatcacacaggccaaggacaagatcggggagatgtcgtgcaacccaagttttggtgggattggaaaagancatttgatgcgtgaaattgatgcaatggacggagtttgcccaaggatttgtgaccaaaccggaattcatttccatgttctaaataggcgccatgggccagcagttattgggcttagggcgttgattgacaggaaactctacaagaaggaaatgcaaaaagaaattgaaaacactgccaatttggagattattgagggaacggtcgaggacctttgcattgaggaggccactcgttcatcatccaattacacacaccgacaannnattaaagcgcctgccgtgatcattacgaccggcacattcctcaatggcacccttctatggggcaacaagaaagtaatgggtggccgaattggggaaggatcaagcatgggattggcaganactttcaaccgacttggcttcaaaactggacgactcagtacgggaacaccgccaagattgctggcaaaaaccattgacttttcgcgtttcacggaacaatccagcgatgacaatccaatcccattctctttttcaatcaaaaatgttggaattgcgcgtgaacaacacctcagttcatatgtgggctacaccaatgagcgggtggtggaaattgtgcgcaaaaacattgacgaaaagcacacattgtaaaaaagatgtttaggtcctcggtattgtccctcactagaagcaaaatgtctacgattcggggatttaaagcatcgagtatttttggagcccgagggtttggaaagtgaattgatttacccacaggggtgcgcccttggctttgagaaggaagtccagcagcaaataatgcgtgcaattgaagggctggagaatgtggaantcncncnncnagngtatnnnntnnnntacnantttnttnatccncnnnanttnnannnntcgttngaancnnaannantnnnnnnnctntttttggcaggncanatnaatggcacnacnggctangaggangcngcngcncanggnntnatngccggcnnnaangcngcnntnnnnnnnaangaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccaggccagacaatgctgacttgcggctgacggaaattgccaggagttttgggcttgtttcaaacaaacgttgggagatattccagaagaggatnaggcgaancgaaatgctnagggaaangctgnattctttgaaattcacttcagcatcatggaatgancgaattcccggactgaacacaccnggaaggactgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 741 - DNA, 3132 bp, Artificial Sequence
  Description of Artificial Sequence: Synthetic polynucleotide
  modified_base (30)..(30): a, c, t, g, unknown or other
  modified_base (33)..(34): a, c, t, g, unknown or other
  modified_base (51)..(51): a, c, t, g, unknown or other
  modified_base (57)..(57): a, c, t, g, unknown or other
  modified_base (78)..(78): a, c, t, g, unknown or other
  modified_base (111)..(111): a, c, t, g, unknown or other
  modified_base (115)..(115): a, c, t, g, unknown or other
  modified_base (132)..(132): a, c, t, g, unknown or other
  modified_base (138)..(138): a, c, t, g, unknown or other
  modified_base (147)..(147): a, c, t, g, unknown or other
  modified_base (151)..(151): a, c, t, g, unknown or other
  modified_base (156)..(156): a, c, t, g, unknown or other
  modified_base (180)..(180): a, c, t, g, unknown or other
  modified_base (183)..(184): a, c, t, g, unknown or other
  modified_base (186)..(186): a, c, t, g, unknown or other
  modified_base (202)..(273): a, c, t, g, unknown or other
  modified_base (288)..(289): a, c, t, g, unknown or other
  modified_base (303)..(303): a, c, t, g, unknown or other
  modified_base (306)..(306): a, c, t, g, unknown or other
  modified_base (309)..(309): a, c, t, g, unknown or other
  modified_base (324)..(324): a, c, t, g, unknown or other
  modified_base (348)..(348): a, c, t, g, unknown or other
  modified_base (360)..(360): a, c, t, g, unknown or other
  modified_base (363)..(363): a, c, t, g, unknown or other
  modified_base (417)..(417): a, c, t, g, unknown or other
  modified_base (420)..(420): a, c, t, g, unknown or other
  modified_base (489)..(489): a, c, t, g, unknown or other
  modified_base (615)..(615): a, c, t, g, unknown or other
  modified_base (645)..(645): a, c, t, g, unknown or other
  modified_base (671)..(676): a, c, t, g, unknown or other
  modified_base (678)..(678): a, c, t, g, unknown or other
  modified_base (681)..(681): a, c, t, g, unknown or other
  modified_base (1116)..(1116): a, c, t, g, unknown or other
  modified_base (1149)..(1149): a, c, t, g, unknown or other
  modified_base (1206)..(1206): a, c, t, g, unknown or other
  modified_base (1224)..(1224): a, c, t, g, unknown or other
  modified_base (1296)..(1296): a, c, t, g, unknown or other
  modified_base (1353)..(1353): a, c, t, g, unknown or other
  modified_base (1369)..(1369): a, c, t, g, unknown or other
  modified_base (1392)..(1392): a, c, t, g, unknown or other
  modified_base (1401)..(1401): a, c, t, g, unknown or other
  modified_base (1434)..(1435): a, c, t, g, unknown or other
  modified_base (1461)..(1461): a, c, t, g, unknown or other
  modified_base (1468)..(1470): a, c, t, g, unknown or other
  modified_base (1476)..(1476): a, c, t, g, unknown or other
  modified_base (1744)..(1812): a, c, t, g, unknown or other
  modified_base (1890)..(1890): a, c, t, g, unknown or other
  modified_base (2242)..(2433): a, c, t, g, unknown or other
  modified_base (2722)..(3132): a, c, t, g, unknown or other
atgcgtataaaaattgacaatcgcattcgnacnntggtggaaaatggaatnattacncggcatcgttcaatgttcatnattattggggacaaagcacgggatcaagtggtnaccntgcaccatattttaacnaaagcnggaatttcngcgngaccntcggttttatggtgttacaaaaanganntngacatcagttcacacnnnnnnnnnnnnnnnnnnnnnnnnnnnnnnnnnnnnnnnnnnnnnnnnnnnnnnnnnnnnnnnnnnnnnnnnttcgagcagttcatnntggccacacacatncgntantgttactacgccgantcccatcgcattttgggcaacacntttggcatggcngtncttcaagttttcgaagcattaacccccaatttacttgcccgaaccattgaaacngtngagggtggcggattgattgttttgctgctgcaaagcgtgcactccttgaagcagttgtacacaatgacnatggatgtgcacaaacgctatcgcacagaagcgcattccgacgtggttggacgttttaatgaacgctttattctctcgctggccacttgtccgacttgtgtgctcatggatgattgcctcaatgtnttgcccatttcttcggccatctcaaaaatnacgccaattcctgcaaatcaaaaagnnnnnnantcngaagcccaattggaattgcaaaaacttcaacgctctttagccgacacaaaacccattggcccactgctgaacaaatgtgccacactgtgccaagcaaaagtgcttctccgcttgttggacgcagccaccgaaaagatgcagaacacaacttgctcaatcacggccgcccgcggtcgcggcaagtcggcagcaatgggcttggctgtggcgggcgccattggctttggctttaccaacattgtggtgaccagcccgagtgtggagaatttgcgcacgctttttgagtttgtggtcaagggattcgaggcgatcggatatcaggaacacgccgactatgaacttgtcaagtccatggacccagtgctggacaaatgtgtgacgcgcgtgaatgtgttcaggaaacacaggcaaactatccagtacattgaaccaacngacgcagtcaaactgttgcaagccgaactggtngttgttgatgaggcggcggcaattcccattccaattgtgaagaagttgattacagancctttcctggtgtttctngcctcaacaataagcggttacgagggcaccggccgatcattgtccctgaaattgttggaacaattgaggcancaacaatccagttcaacaggcgaagaagggaagaaagttggccaacagagaagaacnttgtatgagcttacantggaggagagcattcgctatggngacaatganccggttgaggactggctgaaccgtgtgctctgnntgaatccagtgaatttgaatggaacnatttcannnggcacnccggcacccgaaaaatgccaactgtgccgaggttttcaatattttttattttaatttacttttgtttttttgattttcctctccaatttgatgtccatctatgtggctgctcactacaagaacagtccggatgatttgcagctgctttcggatgcgccggcccatcaaatatttgtcctgatgccgccggtttcgaagaagacaaaatcaatccctcaaattctggccgttcttcaaatctgctttgaaggtaaatatgaggaaaatnnnnnnnnnnnnnnnnnnnnnnnnnnnnnnnnnnnnnnnnnnnnnnnnnnnnnnnnnnnnnnnnnnnnnaatttttaggattccgatttcccccaactttgcggcgctcggatagttcggattgcagtgcatcctgattttcaagcnatgggctatggctctcgtgcaatccaactggtccagcaatattatcaaggaaaattcagtacatttgagccaacaaattcaactgaaaacgatgaagcaaatgcagatgagtccatggaagtcattgatgaggattgtcaactgcttcaagaggaaattacacctcgtgcaaatttgcctccccttttgcaacgtttggccgaaagaccggccgaacgcctcgactacatgggcgcttgttttggccttaccctgccacttttgaagttctggaaacggcttggatttctgcctgttcatttacgccaaagcgcaaacagcttaactggagagcatagttgcattcttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctcagccgcgttgaacttcgctgggtgctgtcggatttggatctccgccgattggcgcattacgcgaagaatttggcggaccagcagttgataaccgatttgctgcctgcccttggctcactctatttccagggacggcttggaccggatgcacagcttgaacttggccaagctgccgtccttttaggagttggcctacagcgaaagtcggttgaggaaattgcccgccaattggaattgccttccaaccaatgccatgccctcctcaacaaagctgttcgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 742 - DNA, 645 bp, Artificial Sequence
  Description of Artificial Sequence: Synthetic polynucleotide
  modified_base (1)..(6): a, c, t, g, unknown or other
  modified_base (186)..(186): a, c, t, g, unknown or other
  modified_base (348)..(348): a, c, t, g, unknown or other
  modified_base (492)..(492): a, c, t, g, unknown or other
  modified_base (643)..(645): a, c, t, g, unknown or other
nnnnnnttgacgcttattgctcgagtgaacgacggcttgatattggcaacatcaatcgagggtgcagatgattttcagcctgaacaaaatttggtgaaatacatgagtcaagcaaagatgatattccgaaaattgaacaacacgcctcaagttcagtccatttccagcggtcaatatttcttctantatctcatcaaaagctcaatatgtgttcttacactttgtgatcaaaatttttcgaggaaggcggcctttgcctacttggaagaaatcgcaacggaatttctgaaccagtatgccacccaagttggctccaccacacggccatatcacttcctggaatttacnagttatattcaaactgcaaagaagaaacacactgacaagggacgcagtgcaatagcagcggttaacaacgaattgcaagacgtcacaaggattatggtttcgaacattgaggatgttattcaccgtggcgaagcacttaacttnctggaatccagagcatcggatctttcccacctcagcaagaagtatcgcgaggacgctcgtcaactgaatcgacggactgccgtgttcaaactgtttgttgggattggaattgcgagcattctcttcctcatattccgatttgtatacttcnnn

SEQ ID NO: 743 - DNA, 492 bp, Artificial Sequence
  Description of Artificial Sequence: Synthetic polynucleotide
  modified_base (1)..(120): a, c, t, g, unknown or other
  modified_base (355)..(492): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattctacgccaataccgtggtcaagcaaatcgacgtgcctgggatggccaccaacatgggaatcctgcccatccacgtgcccaccattgccgtcctgaagccgggcattttgacggtctacgaggtggagggcaatcccagcaagttcttcgtctcctccggctcgctgtccatgaacattgacgggagttgccaaattctggccgaggagattgccgctcttgatgacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 744 - DNA, 555 bp, Artificial Sequence
  Description of Artificial Sequence: Synthetic polynucleotide
  modified_base (1)..(12): a, c, t, g, unknown or other
  modified_base (169)..(171): a, c, t, g, unknown or other
  modified_base (180)..(180): a, c, t, g, unknown or other
  modified_base (235)..(237): a, c, t, g, unknown or other
  modified_base (379)..(379): a, c, t, g, unknown or other
  modified_base (381)..(382): a, c, t, g, unknown or other
  modified_base (384)..(384): a, c, t, g, unknown or other
  modified_base (387)..(388): a, c, t, g, unknown or other
  modified_base (390)..(398): a, c, t, g, unknown or other
  modified_base (400)..(400): a, c, t, g, unknown or other
  modified_base (403)..(403): a, c, t, g, unknown or other
  modified_base (432)..(432): a, c, t, g, unknown or other
  modified_base (553)..(555): a, c, t, g, unknown or other
nnnnnnnnnnnngatttagacgctgcttcactttacagtataaaagcaattttgattcttgatcaagatggaaagcggattctgggcaagtattacgacaaggacatttttccaatggagaagggacaaaccactttcgagaagaacctcttccagaaaacgcacaaannngcaaatgtngaaataatcttgctggatggcctgatttgtgtttaccgctccaatgtggatctgnnnttctatgttattgggagtgcgcatgagaatgaacttattttgcaaagcgtcctgaattgcctctacgaagccttctcaattgtgctgcgaaagaatgttgagaagaaggccctttttgagcatcttgatacggccttcctcntnntngannannnnnnnnntnatngtgtgattttggaaaccgacgcacaaaangtggtggcccgctgtgctgtgaagcccgatgaggtcgcatttggagagcaaacgatttcgcaggtcgggatgtccttgctaggctcggccaaggatcaattgaaatggtcgttgcttaaannn

SEQ ID NO: 745 - DNA, 1026 bp, Artificial Sequence
  Description of Artificial Sequence: Synthetic polynucleotide
  modified_base (1)..(15): a, c, t, g, unknown or other
  modified_base (129)..(129): a, c, t, g, unknown or other
  modified_base (135)..(135): a, c, t, g, unknown or other
  modified_base (293)..(293): a, c, t, g, unknown or other
  modified_base (305)..(309): a, c, t, g, unknown or other
  modified_base (311)..(312): a, c, t, g, unknown or other
  modified_base (316)..(316): a, c, t, g, unknown or other
  modified_base (320)..(337): a, c, t, g, unknown or other
  modified_base (339)..(342): a, c, t, g, unknown or other
  modified_base (344)..(344): a, c, t, g, unknown or other
  modified_base (483)..(483): a, c, t, g, unknown or other
  modified_base (510)..(510): a, c, t, g, unknown or other
  modified_base (681)..(681): a, c, t, g, unknown or other
  modified_base (769)..(775): a, c, t, g, unknown or other
  modified_base (777)..(784): a, c, t, g, unknown or other
  modified_base (787)..(789): a, c, t, g, unknown or other
  modified_base (791)..(792): a, c, t, g, unknown or other
  modified_base (794)..(796): a, c, t, g, unknown or other
  modified_base (816)..(816): a, c, t, g, unknown or other
  modified_base (930)..(930): a, c, t, g, unknown or other
  modified_base (933)..(933): a, c, t, g, unknown or other
  modified_base (978)..(978): a, c, t, g, unknown or other
  modified_base (1024)..(1026): a, c, t, g, unknown or other
nnnnnnnnnnnnnnntcggaatacgggattgagacagattccgtgacgcttcaacgctttgtgctaaacgagcagcgaaagtttccggatgctaccggcgatttgactactctgttgaccagtctgttnaccgcngttaaagctatctcctcggctgtcagaaaagcaggattggcccagctgtacggggtggcaggaaatgtgaatgttcagggcgaggatgtgaagaagctggacgtgctcagcaatgagctgatgatcaacatgctgaagtcgtcgtatacggtttgccnttattgaaatgnnnnntnngcantcannnnnnnnnnnnnnnnnncnnnngnaggcaaatacattgtcacatttgacccgttggacggttcctccaacattgactgcctcgtctcgattggcaccattttcggcatcttcaagaaaacagcggatggacaggcccagattcaagacattctccagccggancggaaaatggttgctgctggataccanctttacggttcggctaccatggtggtgctttccacgcctggccgtgtggatgggttcactcttgatccaagcattggcgagttcatcctgaccaatccggccatgagctgccgaaaaagggcaaagatttacagcatcaacgagggctatgccaagaagtggtccaaaganatcacggaatacatccattcccgaaagttcccggaagatggcaagtccgcttacggtcaacgctatgtcggctccatggtgccgacgnnnnnnngnnnnnnnnttnnngnngnnnttttcatgtacccagcaacnagcattgcaccgaatggaaagcttcgcctcctctacgagtgcaacccaatggcattcatcatggagaatgcgggcggattggcaagcaccggccatggcccaatccttgacatncanccaaaaagcattcatcaacggactccaatctttttgggctccaangaggatgtggaagaatgtgttggctacattcagaaatttgacaatnnn

SEQ ID NO: 746 - DNA, 1329 bp, Artificial Sequence
  Description of Artificial Sequence: Synthetic polynucleotide
  modified_base (1)..(45): a, c, t, g, unknown or other
  modified_base (223)..(300): a, c, t, g, unknown or other
  modified_base (309)..(309): a, c, t, g, unknown or other
  modified_base (312)..(312): a, c, t, g, unknown or other
  modified_base (328)..(328): a, c, t, g, unknown or other
  modified_base (330)..(330): a, c, t, g, unknown or other
  modified_base (351)..(351): a, c, t, g, unknown or other
  modified_base (375)..(375): a, c, t, g, unknown or other
  modified_base (387)..(387): a, c, t, g, unknown or other
  modified_base (408)..(408): a, c, t, g, unknown or other
  modified_base (435)..(435): a, c, t, g, unknown or other
  modified_base (442)..(442): a, c, t, g, unknown or other
  modified_base (447)..(447): a, c, t, g, unknown or other
  modified_base (451)..(451): a, c, t, g, unknown or other
  modified_base (453)..(453): a, c, t, g, unknown or other
  modified_base (460)..(461): a, c, t, g, unknown or other
  modified_base (471)..(471): a, c, t, g, unknown or other
  modified_base (480)..(480): a, c, t, g, unknown or other
  modified_base (483)..(483): a, c, t, g, unknown or other
  modified_base (488)..(490): a, c, t, g, unknown or other
  modified_base (507)..(507): a, c, t, g, unknown or other
  modified_base (522)..(522): a, c, t, g, unknown or other
  modified_base (528)..(528): a, c, t, g, unknown or other
  modified_base (579)..(579): a, c, t, g, unknown or other
  modified_base (591)..(592): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (630)..(630): a, c, t, g, unknown or other
  modified_base (639)..(639): a, c, t, g, unknown or other
  modified_base (654)..(654): a, c, t, g, unknown or other
  modified_base (699)..(699): a, c, t, g, unknown or other
  modified_base (960)..(960): a, c, t, g, unknown or other
  modified_base (964)..(964): a, c, t, g, unknown or other
  modified_base (966)..(966): a, c, t, g, unknown or other
  modified_base (969)..(970): a, c, t, g, unknown or other
  modified_base (976)..(976): a, c, t, g, unknown or other
  modified_base (978)..(978): a, c, t, g, unknown or other
  modified_base (984)..(984): a, c, t, g, unknown or other
  modified_base (987)..(988): a, c, t, g, unknown or other
  modified_base (990)..(990): a, c, t, g, unknown or other
  modified_base (1002)..(1002): a, c, t, g, unknown or other
  modified_base (1005)..(1005): a, c, t, g, unknown or other
  modified_base (1009)..(1009): a, c, t, g, unknown or other
  modified_base (1011)..(1011): a, c, t, g, unknown or other
  modified_base (1035)..(1035): a, c, t, g, unknown or other
  modified_base (1038)..(1038): a, c, t, g, unknown or other
  modified_base (1041)..(1041): a, c, t, g, unknown or other
  modified_base (1047)..(1047): a, c, t, g, unknown or other
  modified_base (1049)..(1050): a, c, t, g, unknown or other
  modified_base (1059)..(1060): a, c, t, g, unknown or other
  modified_base (1071)..(1071): a, c, t, g, unknown or other
  modified_base (1078)..(1078): a, c, t, g, unknown or other
  modified_base (1081)..(1081): a, c, t, g, unknown or other
  modified_base (1083)..(1083): a, c, t, g, unknown or other
  modified_base (1086)..(1086): a, c, t, g, unknown or other
  modified_base (1098)..(1099): a, c, t, g, unknown or other
  modified_base (1102)..(1102): a, c, t, g, unknown or other
  modified_base (1107)..(1107): a, c, t, g, unknown or other
  modified_base (1111)..(1113): a, c, t, g, unknown or other
  modified_base (1118)..(1119): a, c, t, g, unknown or other
  modified_base (1123)..(1123): a, c, t, g, unknown or other
  modified_base (1126)..(1126): a, c, t, g, unknown or other
  modified_base (1129)..(1129): a, c, t, g, unknown or other
  modified_base (1131)..(1131): a, c, t, g, unknown or other
  modified_base (1134)..(1134): a, c, t, g, unknown or other
  modified_base (1137)..(1137): a, c, t, g, unknown or other
  modified_base (1143)..(1143): a, c, t, g, unknown or other
  modified_base (1146)..(1146): a, c, t, g, unknown or other
  modified_base (1149)..(1149): a, c, t, g, unknown or other
  modified_base (1152)..(1152): a, c, t, g, unknown or other
  modified_base (1155)..(1155): a, c, t, g, unknown or other
  modified_base (1161)..(1161): a, c, t, g, unknown or other
  modified_base (1167)..(1167): a, c, t, g, unknown or other
  modified_base (1175)..(1176): a, c, t, g, unknown or other
  modified_base (1179)..(1182): a, c, t, g, unknown or other
  modified_base (1196)..(1196): a, c, t, g, unknown or other
  modified_base (1200)..(1200): a, c, t, g, unknown or other
  modified_base (1216)..(1216): a, c, t, g, unknown or other
  modified_base (1224)..(1224): a, c, t, g, unknown or other
  modified_base (1227)..(1227): a, c, t, g, unknown or other
  modified_base (1230)..(1230): a, c, t, g, unknown or other
  modified_base (1251)..(1251): a, c, t, g, unknown or other
  modified_base (1263)..(1264): a, c, t, g, unknown or other
  modified_base (1269)..(1269): a, c, t, g, unknown or other
  modified_base (1272)..(1272): a, c, t, g, unknown or other
  modified_base (1278)..(1329): a, c, t, g, unknown or other
nnnnnnnnnnnnnnnnnnnnnnnnnnnnnnnnnnnnnnnnnnnnngcatcattcctttgggatttctaccttacatggcgccaatatcaggtttaccggcgcacccagaaacggccagcagcagtcgctgatatcatttcggaggaggattttgagaaggcacgagactacaagctcgacaaaatgcactttgggtttttctcgatggcctttggcaagctgnnnnnnnnnnnnnnnnnnnnnnnnnnnnnnnnnnnnnnnnnnnnnnnnnnnnnnnnnnnnnnnnnnnnnnnnnnnnnnctgtttacntgnttgtcatccatcattngnacgatcagtgacctgccattntcctactacgacactttctacatngagcaaaagcanggcttcaacaaggagacggtnccattcttcttcaaagatcgcctgaanaagtggntgctnggtntngtaatcnncgctcccatnacggccgcntanatttnnnttgtccactggggaggnccaaacttctacgtntacgtntggctgttcatctcggctgtcattttcgttttcatgtttatctatccgganttcatcgctccnntnttngacaantacaccccactgccggaaagcccgctncgaacgaanattgaggaactggcngggcgagtttcattcccactgacaaaaatttttgtggttgaagcntcaaaacggtcggcccatagcaatgcctatatgtacggcttctggaagaacaaacggattgtgctgtacgacacgctgctcagcgaggagaaacccgaaaacgacacgaatgctgagacaaaatcggaagaaccggtggccgagccaaacgatgagaaaaagcgcggcatgagcgacgaggaagtggtcgcagtgctaggtcacgagcttggccattggaaggagatgcactccgtgttccagctggtcatctcggagatnaacntnttnntcatgntnttggtnttnncnttcttctaccgncangagngnctgttcgttgccttcggatttgcngancancccgtntnnattggcctnntgctggtgttncaatacntgntnggnccctaccagganntgntatcnctgnnnattgnngtgntgngcngncgnttngaattngcngcngancgntttgcngcacgncttggctnngcnnnnaagttgcagagtgnactnatcaaattgggccaanacaacctntcnctncccatcgacgactggctctantcggcctgcaannattcncanccgccnnnnnnnnnnnnnnnnnnnnnnnnnnnnnnnnnnnnnnnnnnnnnnnnnnnn

SEQ ID NO: 747 - DNA, 1059 bp, Artificial Sequence
  Description of Artificial Sequence: Synthetic polynucleotide
  modified_base (1)..(375): a, c, t, g, unknown or other
  modified_base (466)..(466): a, c, t, g, unknown or other
  modified_base (468)..(468): a, c, t, g, unknown or other
  modified_base (474)..(474): a, c, t, g, unknown or other
  modified_base (549)..(549): a, c, t, g, unknown or other
  modified_base (564)..(564): a, c, t, g, unknown or other
  modified_base (600)..(600): a, c, t, g, unknown or other
  modified_base (636)..(636): a, c, t, g, unknown or other
  modified_base (639)..(639): a, c, t, g, unknown or other
  modified_base (672)..(672): a, c, t, g, unknown or other
  modified_base (675)..(675): a, c, t, g, unknown or other
  modified_base (678)..(678): a, c, t, g, unknown or other
  modified_base (681)..(681): a, c, t, g, unknown or other
  modified_base (690)..(690): a, c, t, g, unknown or other
  modified_base (714)..(714): a, c, t, g, unknown or other
  modified_base (726)..(726): a, c, t, g, unknown or other
  modified_base (738)..(738): a, c, t, g, unknown or other
  modified_base (741)..(741): a, c, t, g, unknown or other
  modified_base (753)..(753): a, c, t, g, unknown or other
  modified_base (822)..(822): a, c, t, g, unknown or other
  modified_base (873)..(873): a, c, t, g, unknown or other
  modified_base (918)..(918): a, c, t, g, unknown or other
  modified_base (924)..(924): a, c, t, g, unknown or other
  modified_base (927)..(927): a, c, t, g, unknown or other
  modified_base (985)..(1059): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtcttcatcgtcaagggcaaggaggacgcgctggtcaccaagaacctagtgcccggcgaatccgtctacggcgagaagcgcatttccntncagganggccacaagggcacggagtaccgcgtgtggaacccgttccgctccaagctggccgcctcaatcatggccggcatngaggactcgcacatnttcccgggcgcgcgtgtgctctacctgggtgcggcntcgggcacctccgtttcccatgtgtcggacattgtnggnccggaaggcattgtctacgccgttgagttctcncancgnagngggcgtganctgttgggcatggccaagaagcgnccgaatgtggtncccattgttgangangcacggcacccncacaaatatgcgatgatggtgggcattgtggacacaatcttctcggacgtggcccaacccgaccaggcncgcattgtggcccacaacgcgcacaaattcctgaagaacaacggccacgcngtcatctccatcaaggccaactgcattgacagcacggccgagccngaggcngtntttgccggggaagtgaacaaactgcgcgaggagcagttcaagcccattgaacaggtannnnnnnnnnnnnnnnnnnnnnnnnnnnnnnnnnnnnnnnnnnnnnnnnnnnnnnnnnnnnnnnnnnnnnnnnnn

SEQ ID NO: 748 - DNA, 1758 bp, Artificial Sequence
  Description of Artificial Sequence: Synthetic polynucleotide
  modified_base (1)..(6): a, c, t, g, unknown or other
  modified_base (83)..(83): a, c, t, g, unknown or other
  modified_base (97)..(97): a, c, t, g, unknown or other
  modified_base (100)..(104): a, c, t, g, unknown or other
  modified_base (441)..(445): a, c, t, g, unknown or other
  modified_base (447)..(448): a, c, t, g, unknown or other
  modified_base (450)..(1758): a, c, t, g, unknown or other
nnnnnnctaaaaattctatacggcacagaaacgggcaatgccgaagattttgcgcaacagctctggcgactttgcagaagagnaaatgttcgggccnaannnnnggcaattgatgattttggaattcaggatttatgcgatgaaaaatttgtgattttcattgtgtccactacgggtcaaggcgaaatgccagcgaacatgcgcaacgcgtggaggtttttgctgtccaaaaagctggaacggacatggcttggaaatctaaaatttgcccttctcggccttggcgacagctcctaccaaaagtacaattttgccggcaaaaagctgtaccgacgactcctccaactcggtgcccacccgattctggacatggcactggccgatgagcagcatccactgggcattgagcacagctttgaggaatggagtgaacaattgttnnnnnanntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 749 - DNA, 1659 bp, Artificial Sequence
  Description of Artificial Sequence: Synthetic polynucleotide
  modified_base (1)..(246): a, c, t, g, unknown or other
  modified_base (469)..(756): a, c, t, g, unknown or other
  modified_base (831)..(831): a, c, t, g, unknown or other
  modified_base (951)..(951): a, c, t, g, unknown or other
  modified_base (1011)..(1011): a, c, t, g, unknown or other
  modified_base (1095)..(1095): a, c, t, g, unknown or other
  modified_base (1362)..(1362): a, c, t, g, unknown or other
  modified_base (1461)..(1461): a, c, t, g, unknown or other
  modified_base (1475)..(1476): a, c, t, g, unknown or other
  modified_base (1478)..(1478): a, c, t, g, unknown or other
  modified_base (1483)..(1483): a, c, t, g, unknown or other
  modified_base (1657)..(1659): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccagagcaatgagttggcaaaagagcttgggattgaccaccaaaaattgattggcgctgtgaaaagcttgcaaacccatgatgggataatcaacgtgaaggatatgaagatcaagcggttggaattgacggcggaaggcgaacaagttctggcaaatggctcccatgaatacaacctttacaagctggttggtgaaaatggagtgcccaaggcgataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgcagtggctcatggcgtgacaaacaattcaaaaagtacaacttcgaggcaatgggagtgccaccgcccagnggccacctgcatccgctgctgaaggttcgatccgagttcagggacattttcttccaaatgggcttctccgagatgccaaccaatcgttttgtggaatcctccttctggaactttgacgcnctcttccaaccgcaacagcacccagctagggattcccatgacactttcttcctttctggnccagcaatatcgacagaatttccggaggattacctggaacgtgtgaagaaggttcattccgagggtggctatgcttccattggntatcaatacgattggaaattggaagaagcgcaaaagaatgtgctcagaacgcacaccaccgccgtctcagcccgtcaactttacttgctggcacagagtgacttcaaacccgccaaaatgttcagcattgatcgggtgttcagaaatgaaacgttggatgccacccacttggccgagttccatcaagtcgagggcgtagtcgccgaacgaaatctctctctggcgcatgtcattggactgttcacggagttcttcaggaaatgcganattgaaaacttgcgcttcaagccaacctacaacccctataccgaaccttcaatggaaatattcgcatatcatgaggggctgaagaaatgggtggaaatnggcaactcgggcanntnccggncagaaatgcttctgcccatgggattgcccgaggatgttgctgtcgctggctttgggctttcattggagaggccaacaatgatccgctacgggctctccaacattcgcgaactctttggccacaaaattgacttgcagatggtctacaacaacccgatttgccaattggacaagnnn

SEQ ID NO: 750 - DNA, 1776 bp, Artificial Sequence
  Description of Artificial Sequence: Synthetic polynucleotide
  modified_base (43)..(43): a, c, t, g, unknown or other
  modified_base (115)..(171): a, c, t, g, unknown or other
  modified_base (391)..(391): a, c, t, g, unknown or other
  modified_base (533)..(533): a, c, t, g, unknown or other
  modified_base (607)..(607): a, c, t, g, unknown or other
  modified_base (687)..(687): a, c, t, g, unknown or other
  modified_base (850)..(1035): a, c, t, g, unknown or other
  modified_base (1338)..(1338): a, c, t, g, unknown or other
  modified_base (1465)..(1465): a, c, t, g, unknown or other
  modified_base (1479)..(1479): a, c, t, g, unknown or other
  modified_base (1578)..(1578): a, c, t, g, unknown or other
  modified_base (1593)..(1594): a, c, t, g, unknown or other
  modified_base (1599)..(1601): a, c, t, g, unknown or other
  modified_base (1603)..(1604): a, c, t, g, unknown or other
  modified_base (1606)..(1617): a, c, t, g, unknown or other
  modified_base (1660)..(1662): a, c, t, g, unknown or other
  modified_base (1774)..(1776): a, c, t, g, unknown or other
atgccaaccatttctgtcaaaaagcgacttttggacaagcacntgggcaactcattaagccaagaggaagtggatgaactgtgcttccagtatggacttgaattggacgatgtgnnnnnnnnnnnnnnnnnnnnnnnnnnnnnnnnnnnnnnnnnnnnnnnnnnnnnnnnngaggaggaggaagtctacaagattgaaatccccgcaaaccgatatgatctgctctgcgttgagggcctgacccgttcattgctgatattccagaacaagtgggaatttttgtcaaatttttatcataatttaatgaaaacgccgcattacaaactggccaaaatgaagaaaacagccgatgtgcggaaatttgttgttggcgctgtgctgcgcgatattnaattgaacgccgagaactacgcctcattcatcgacttgcaagacaaactccaccagaacattggccgaaagcgaacactggcctccattggcacacacgacttggacacaattaaagtccctttccgctattgcgcacagcnaccaaaggagattgtgttcaagccgctcaatcaaagcaaggaattcaatgcagcggaattgatggaattttatnagagtgacagccatttgcgcgactatctgcccataatccgtgaaaagccgctctacccggtcatttacgactccaatggngtggtttgctcccttccgcccataatcaacagcgagcactccaaactgacgctgaacaccaagaacatcttcatcgagtgcacggggacggacttgaagaagttggagattgtgctggacactgtggtcatcctgttcagccaatactgccgcacgccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaattcaggtcacaattccaccgaatcggcacgacattctgcacgagtgcgacttggcagaggacttggcccttgcctttggctacaatgcgattgcgccctgcctgccccaatccaacacggtggcccagccattcccgctgaacaaactctccgaccagttgcgccaccaactggcccagtgtgggtggacggaggtgctgaactttgcgctttgttcgaccgaggatgtttccgcaaagatgcgaagaccggaggagttgggagaagtggtgaaaattgcaaatccgaagacactngaatttcaggttgtccgaacatggcttctcccgggcattctgaagaccatctccaacaacaaggacatgccgctgccattgcgccttttcgaggtgcaggatgttgtgttcattgacgggacaaaanccacaaaatgccgnaatgaacgccacttggccgcggtgttctacagcaagacgggcgcctttgaagtgatccatgggctgttggatcgactcatgcaaatgctggccattccntacattggtgcgggnnaagannntnntnnnnnnnnnnnntcagacccaactttcttcaatggccgttgtgcggaagtgctgnnntacgctggcaagccaatgggcacctttggcgtgctccatcccgaagtgcttatcaaatttgggctggtcaatccgtgttctgcgctggagatcaacattgagcccttcctcnnn

SEQ ID NO: 751 - DNA, 1335 bp, Artificial Sequence
  Description of Artificial Sequence: Synthetic polynucleotide
  modified_base (43)..(43): a, c, t, g, unknown or other
  modified_base (60)..(60): a, c, t, g, unknown or other
  modified_base (393)..(393): a, c, t, g, unknown or other
  modified_base (996)..(996): a, c, t, g, unknown or other
  modified_base (1140)..(1140): a, c, t, g, unknown or other
  modified_base (1327)..(1335): a, c, t, g, unknown or other
atggatgaggaatatgacgccattgttcttgggacaggattgnaggaatgcattttgtcnggaatgctttcggtttcgggcaagaaagtgctccatattgaccgcaacaattactatggcgccgattcggcctcgctgactccactggatgagttgtacaagaaattcaaaggtgccgacgcaaaagcgcccgaaacaatggggaagggccgtgactggaatgtggatctgattccgaagtttctgatggccaacggacaactggtcaaactgctgatccacaccggtgtgacccgctacctggagttcaagtccatcgagggttcctatgtgtacaagggcggcaaggtttacaaagtgccggctgatgagatggaggcgctggcaacaacnttgatgggaatgttcgagaagcgtcgtttcaagaagttcttggtttgggtgcagtcatttgatccgaacgacccgaagacctgggaaggcatggacccgaataacaccgccatgcaacaggtgtatgagaagttcggactggacgaaaacaccgccgactttacgggccatgcactggccctttaccgtgacgacaactacaaacaacaaccgtacacccaaactgtgcaacgcattcgtctgtacagcgactcgctggctcgctatgggaagtcgccgtacctttatccactctatggtttgggcgaactgccgcaaggatttgcgcgcctttcgagcatttatggcgggacttacatgctggacaagcccgtggactccattgtcttcgagaatggcaaagcggttggggttaaaagtggcaatgaggtggccaagtgcaaacaggtctactgtgacccctcctatgtgagcaccaaagtgaagaaggttggccaggtggttcgtgcaatttgcctcctaagtcacccaattgcgaacaccaatgatgcggccagttgccaaataatcattccacaaaagcaagttggacgtcattccacnatttacatttcgtgcgtttccaactcgaaccaggtggcacccaaaggctggtacattgccaacgtgtccaccactgtcgagactgcaaatcccgaggctgaaattcaaccggctttgcaacttcttggacacatcactgaagantttgtgaccgtctcggacatttatgagcccgtcgactatggctacgactcgcaagtgttcatctcccgttcgttcgatgcaaccacccacttcgagacaacctgcctggacgtgctggacattttcaagcgtggaaccacccaggaatttgactttggcaaaatcacccatttgagcttggaggacnnnnnnnnn

SEQ ID NO: 752 - DNA, 1068 bp, Artificial Sequence; identical to SEQ ID NO: 325
  Description of Artificial Sequence: Synthetic polynucleotide
  modified_base (1)..(90): a, c, t, g, unknown or other
  modified_base (347)..(349): a, c, t, g, unknown or other
  modified_base (391)..(391): a, c, t, g, unknown or other
  modified_base (411)..(411): a, c, t, g, unknown or other
  modified_base (438)..(438): a, c, t, g, unknown or other
  modified_base (450)..(450): a, c, t, g, unknown or other
  modified_base (453)..(453): a, c, t, g, unknown or other
  modified_base (481)..(483): a, c, t, g, unknown or other
  modified_base (793)..(1068): a, c, t, g, unknown or other

SEQ ID NO: 753 - DNA, 1656 bp, Artificial Sequence
  Description of Artificial Sequence: Synthetic polynucleotide
  modified_base (1)..(210): a, c, t, g, unknown or other
  modified_base (600)..(600): a, c, t, g, unknown or other
  modified_base (606)..(606): a, c, t, g, unknown or other
  modified_base (627)..(627): a, c, t, g, unknown or other
  modified_base (642)..(642): a, c, t, g, unknown or other
  modified_base (669)..(669): a, c, t, g, unknown or other
  modified_base (678)..(678): a, c, t, g, unknown or other
  modified_base (825)..(825): a, c, t, g, unknown or other
  modified_base (840)..(840): a, c, t, g, unknown or other
  modified_base (852)..(852): a, c, t, g, unknown or other
  modified_base (891)..(891): a, c, t, g, unknown or other
  modified_base (909)..(909): a, c, t, g, unknown or other
  modified_base (912)..(912): a, c, t, g, unknown or other
  modified_base (921)..(921): a, c, t, g, unknown or other
  modified_base (960)..(960): a, c, t, g, unknown or other
  modified_base (987)..(987): a, c, t, g, unknown or other
  modified_base (1011)..(1011): a, c, t, g, unknown or other
  modified_base (1024)..(1024): a, c, t, g, unknown or other
  modified_base (1026)..(1026): a, c, t, g, unknown or other
  modified_base (1041)..(1041): a, c, t, g, unknown or other
  modified_base (1092)..(1092): a, c, t, g, unknown or other
  modified_base (1095)..(1095): a, c, t, g, unknown or other
  modified_base (1122)..(1122): a, c, t, g, unknown or other
  modified_base (1125)..(1125): a, c, t, g, unknown or other
  modified_base (1155)..(1155): a, c, t, g, unknown or other
  modified_base (1164)..(1164): a, c, t, g, unknown or other
  modified_base (1191)..(1191): a, c, t, g, unknown or other
  modified_base (1194)..(1194): a, c, t, g, unknown or other
  modified_base (1197)..(1197): a, c, t, g, unknown or other
  modified_base (1212)..(1212): a, c, t, g, unknown or other
  modified_base (1264)..(1264): a, c, t, g, unknown or other
  modified_base (1359)..(1359): a, c, t, g, unknown or other
  modified_base (1383)..(1383): a, c, t, g, unknown or other
  modified_base (1401)..(1401): a, c, t, g, unknown or other
  modified_base (1407)..(1408): a, c, t, g, unknown or other
  modified_base (1410)..(1410): a, c, t, g, unknown or other
  modified_base (1416)..(1416): a, c, t, g, unknown or other
  modified_base (1418)..(1418): a, c, t, g, unknown or other
  modified_base (1452)..(1452): a, c, t, g, unknown or other
  modified_base (1504)..(1504): a, c, t, g, unknown or other
  modified_base (1521)..(1521): a, c, t, g, unknown or other
  modified_base (1564)..(1564): a, c, t, g, unknown or other
  modified_base (1566)..(1566): a, c, t, g, unknown or other
  modified_base (1578)..(1578): a, c, t, g, unknown or other
  modified_base (1596)..(1596): a, c, t, g, unknown or other
  modified_base (1645)..(1656): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgccaagccggtgttgaacaataccgcgacaggatgttctcgggtgagccaatcaacttcacggagggccgcgctgtgctgcacattgccttacggaatcgcgcaaacacgccaatacaagtcgatgggaaagatgtgatgcccggagtgaacgctgtgttggagcacatgcgccaattctgctcggaagtgatcggcggacaatggaagggctacacgggcgcaaagatcacggatgtggtgaacattggcattggcggatctgacctgggcccattgatggtcaccgaggcgttgaagccctaccaaacaggcccaaatgtgcactttgtgtccaacattgatggcacacatttgcaagaagtgctgaaaaaggtgcagcccgcntccacnctgttcatcatcgcctccaanacgttcaccacccangagacaatcacaaatgcggagtcggcncgggaaggnttcctctcgcatgccaaagaccctgcccatgtggccaaacactttgtcgcgctgtccacaaatgcaccgaaagtgcaggaatttgccattgccaaagagaacatgtttgagttttgggactgggttggtggccgctattctcttggntccgccattggcctntcgattgccgtnaacattgggttcgacaactttgtggaattgcttgaaggngcccatcttgcggacaancantttcgccangcgccactcgagcaaaatattcccgtcatcctcgccctnctcggtgtgctctacatcaatgtgcanggggccgagacgcacgccctgctnccctatgaccagnanttgcaccgattcgcngcctatttccaacagggcgacatggagagcaacgggaaatacataatgagnaanggccaacgcgtgcaacagtccacgggnccnattgtttggggcgaaccgggaacgaatggncagcacgcnttctaccagctcatccaccagggcacncgnctnatcccgtgcgatttnattgcgcccatccaaagccagaatcccattcggaatggactccatcatcagnttttgctagccaatttcttggcgcagaccgaagccctgatgaaaggcaaatccccagccgaggccgagcaggagctgaaggcgtccggcatggangggcagaaaattaaggaaattttnccgcataaggtttttganggcaanngncccacnanctccattctggtgcccaaactcacgccgaacacnctgggcaccctgattgcgctgtacgagcacaaaatctttgtgcaaggctgcntttgggccatcaactcntttgaccagtggggcgtggagttgggcaagcaattggcaaaangnatcctctcgganctgcaaaaaccgggtccngtgagcagccacgactccagcacgaacgcactgatcaacctggtcaagnnnnnnnnnnnn

SEQ ID NO: 754 - DNA, 1617 bp, Artificial Sequence
  Description of Artificial Sequence: Synthetic polynucleotide
  modified_base (1)..(63): a, c, t, g, unknown or other
  modified_base (262)..(262): a, c, t, g, unknown or other
  modified_base (627)..(627): a, c, t, g, unknown or other
  modified_base (663)..(663): a, c, t, g, unknown or other
  modified_base (666)..(666): a, c, t, g, unknown or other
  modified_base (693)..(693): a, c, t, g, unknown or other
  modified_base (763)..(765): a, c, t, g, unknown or other
  modified_base (924)..(924): a, c, t, g, unknown or other
  modified_base (1132)..(1134): a, c, t, g, unknown or other
  modified_base (1189)..(1189): a, c, t, g, unknown or other
  modified_base (1191)..(1195): a, c, t, g, unknown or other
  modified_base (1197)..(1204): a, c, t, g, unknown or other
  modified_base (1206)..(1209): a, c, t, g, unknown or other
  modified_base (1211)..(1219): a, c, t, g, unknown or other
  modified_base (1221)..(1221): a, c, t, g, unknown or other
  modified_base (1223)..(1223): a, c, t, g, unknown or other
  modified_base (1227)..(1227): a, c, t, g, unknown or other
  modified_base (1230)..(1231): a, c, t, g, unknown or other
  modified_base (1233)..(1236): a, c, t, g, unknown or other
  modified_base (1278)..(1278): a, c, t, g, unknown or other
  modified_base (1308)..(1308): a, c, t, g, unknown or other
  modified_base (1329)..(1329): a, c, t, g, unknown or other
  modified_base (1359)..(1359): a, c, t, g, unknown or other
  modified_base (1362)..(1362): a, c, t, g, unknown or other
  modified_base (1368)..(1368): a, c, t, g, unknown or other
  modified_base (1416)..(1416): a, c, t, g, unknown or other
  modified_base (1425)..(1425): a, c, t, g, unknown or other
  modified_base (1428)..(1428): a, c, t, g, unknown or other
  modified_base (1431)..(1431): a, c, t, g, unknown or other
  modified_base (1612)..(1617): a, c, t, g, unknown or other
nnnnnnnnnnnnnnnnnnnnnnnnnnnnnnnnnnnnnnnnnnnnnnnnnnnnnnnnnnnnnnntcattgacaacatccgcgcgtctttcggcctcgagcgcagaagtgtcccgaattctggaggagaaaatccttggccaagaaacgaagatcaatctggaagaaaccggccgcgtcctgtccatcggtgacggcattgcccgcgtgtatggcctgaagaacatccaagccgaggagatggtggaatttgactcgggaatgnagggaatggccctgaacttggagcccgacaacgtcggcgtggtcgtgttcggcaacgacaaggtgatcaaggagggcgacgtggtcaagcgcacgggatccattgtggacgttggcgtcggcgaggagctgcttggccgtgtggtggacgccctgggcaacccaatcgacggcaagggcccaatcaaagtgagccagcgatcgcgggtggaggtgaaggcgccgggcatcatcccgcgggtgggagtgcgcgaacccatgctgactggcgtcaaggccgtggactcactggtgcccattggacgtggccaacgcgagctgatcattggggaccgtcagtccagcaaaaccgcaatcgccatcganaccatcatcaaccagaagcgcttcaacaccagtgcngangagaagaagaagctgtactgcatctangtggccatcgggcagaagcgttccaccgttgcgcagattgtgaagcgactcaccgatgcggatgccatgnnntacacgatcattgtgtcggcgacggcctcggacgcagcccctctccaattcctggccccctactcgggcgcggccatgggcgagttcttccgcgacaacggcaaacacgcgctgatcatctacgacgacttgtccaagcaagcggtggcctaccgccanatgtccctgctgctgcgccgtcccccagggcgtgaggcctatccaggtgacgtcttctacctgcactcgcgtctgctcgagcgtgccgccaagatgaacgagacccacaagggcggctccatgaccgcgctgcccatcatcgagacccaagcgggagacgtgtccgcctacatccccaccaatgtgatttccatcacggacggccaannnttcctggagaccgagctcttctacaagggtgtccgcccggcaatcaacgtggggntnnnnntnnnnnnnntnnnntnnnnnnnnnanancaantcnntnnnncaggtcgccggctccatgaagctcgagctggcccagtaccgngaggtggccgccttcgcccagttcggctcngacctggacgcctccacccancagctgctcaaccgcggtgtgcgcctcacnganctgctnaaacagggccaatacgtgccgatggccatcgaggagcaggtggccgtnatctacgcnggngtnaagggctacctggacaagattgacccctcccaaatcaccaccttcgagcgcgagtacctggcccacatccgtgcccatgagcaggagctgctgaagacaatccgcgaggagggccagatcacgaccagcacggatgacaagctgaagaagttggtgcaaacgttcctggcgcagttcaagnnnnnn

SEQ ID NO: 755 - DNA, 555 bp, Artificial Sequence
  Description of Artificial Sequence: Synthetic polynucleotide
  modified_base (1)..(75): a, c, t, g, unknown or other
  modified_base (294)..(294): a, c, t, g, unknown or other
  modified_base (379)..(555): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnttttaggttgaaggcgtcgatattgatctgccagaattccaaggagaacccgaagaaattgctgtcaaaaagtgtgcgattgccatcgaaaatgtggatggccccgttctggtggaagacacctgcctctgtttcaacgctcttcacggacttcccggcccttacatcaaatggtttctggaaaaactgaaacccgagggtttggtcaaattactactnggtttcaacgacaagtccgcctattctttgtgcactgttgcctattgtgagggccggaatcgccaaatccttacattccaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 756 - DNA, 1278 bp, Artificial Sequence
  Description of Artificial Sequence: Synthetic polynucleotide
  modified_base (1)..(93): a, c, t, g, unknown or other
  modified_base (201)..(201): a, c, t, g, unknown or other
  modified_base (330)..(330): a, c, t, g, unknown or other
  modified_base (631)..(633): a, c, t, g, unknown or other
  modified_base (1108)..(1110): a, c, t, g, unknown or other
  modified_base (1182)..(1182): a, c, t, g, unknown or other
  modified_base (1245)..(1245): a, c, t, g, unknown or other
  modified_base (1258)..(1278): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggaaattatgcaagcattcacagcagcggctttcgtgatttgatgctccgtccggagcttcttcgcgcaatcattgattgtggtttcgaacatccatcagaatgncaacacgaatgcatcccgcaagcaattttgggcatggatattgtctgccaggcgaaatctggaatgggcaaaaccgccgtttttgttctggcaacactgcaacaattgacgccaatagatggaacatcntctgtgctggtcatgtgccacactcgtgagctggctttccaatctcaaaggaagtatgaacgcttcagcaaatatatgcctggagtcaaggtttctgtcttcttcggtgggatgcccatcaagaaggacgaagagaccctcgccaagaacacaccgcacatcgtcgtgggcacgcctggacgtttgctggcattgggacgtacgggacacttgaagctgaagaatgtgaagttctttgtgctggacgaatgcgacaagatgatcgggatgctggatatgcgccatgatgtgcaggagattnnnaagatgacgccgcaagagaagcaggtcatgatgttcagcgccacactcccacgtgaactacgcgtcgtctgcaagaaattcatgcaagaaccaatggaggtgtacgttgacgacgaagccaagctcactcttcatggtctgcaacaatactacgtccgactgaaggaaaatgagaagaatcgcaaactcttggatttgctcgatgctttggagttcaaccaggtcgtcatctttgtccgctccgtgagtcgctgccgtgccctcaaccaactgctgattgaacaaaacttcccgtccattgccatccaccgtgcaatggcccaagaggagcgtctggggcgttaccagcaattcaaagacttccagaagcgcatccttgtggccaccaacctatttggacgcggaatggacatcgagcgcgtgaacatcgtcttcaattatgacatgccggaagacaccgacacctatttgcacnnngttgcacgtgccgggcgttttggaaccaagggacttgccatcacattcgtttcggacgaaacagatgcccanacactgaacagtgtgcaagaccgcttcgacgtgaccatctcagagctgcctgatcagatcgangtgggcacctatnnnnnnnnnnnnnnnnnnnnn

SEQ ID NO: 757 - DNA, 393 bp, Artificial Sequence
  Description of Artificial Sequence: Synthetic polynucleotide
  modified_base (1)..(6): a, c, t, g, unknown or other
  modified_base (61)..(66): a, c, t, g, unknown or other
  modified_base (388)..(393): a, c, t, g, unknown or other
nnnnnngaagttgaaaaggcgcagaaggcccaggtgcccaagaaggaaaggagacacaatnnnnnntttcggaaaatcgttcgcaaagaattgccggcaaacatcatttatgaagatgatgaggtaatggcattcatggatgttgccccacaagcaccgactcatttcttggttatcccaaagaagccaatagcatccatggacgcttgccagccacaggatgaagcattgctgggaaagttgatgttggcagcagcaaaagttgccaagcagcagggactatctgatggatatcgcattgtggtgaacaatggccgtcacgggtgccagagtgtttaccacctgcatcttcacgttcttggcggccgacaattgggatggccacctnnnnnn

SEQ ID NO: 758 - DNA, 1563 bp, Artificial Sequence
  Description of Artificial Sequence: Synthetic polynucleotide
  modified_base (1)..(195): a, c, t, g, unknown or other
  modified_base (516)..(516): a, c, t, g, unknown or other
  modified_base (841)..(1563): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcactcgcgattttggtccggaacaaatggctgtgcgtgaaaaggttctcggcatcatcaccgagactttcaagcgtcacggggcggttacaattgacacaccggtgtttgagcttcgcaaagttttattgggaaaatacggggatgaaggcaacaaattggtgtacaatttggacgatcaagacggtgaactttgctcgcttcgatacgatcttacggtgccatttgcacgttatttggcaacaaacaaaatagagaagataaagaggtaccaaattgccaaagtttatcgcagagatcagccagttatgaccaaaganagatatcgagaattctaccaatgcgattttgacatagccgggcagggtgaattgatggtccaggaagcagaatgtttgaagatcattgacgaagtgctcaccaaacttgaccttggcgagtttgaaattcgagtgaatcacagacaattgttggaagcgatgtttagtgccagcgggattccctccaatttgttcaaaacagtctcatcatccgtggacaaactcgacaaacaatcttgggccgtggttcgagaggagttgatcaaggagaagggggtggacgagccagcggttgatgcactcggtgaatttgttcggatcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 759 - DNA, 711 bp, Artificial Sequence
  Description of Artificial Sequence: Synthetic polynucleotide
  modified_base (1)..(177): a, c, t, g, unknown or other
  modified_base (294)..(294): a, c, t, g, unknown or other
  modified_base (385)..(390): a, c, t, g, unknown or other
  modified_base (439)..(441): a, c, t, g, unknown or other
  modified_base (484)..(711): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctccaccgcgcattcagtgtgttcatcttcgacagggagcggcgaatgctgctgcaaaagcggtcgcccaccaagatcacgttccccgaggtttggaccaactcttgttgctgncatccgcatttcacgccaccgaaaagtgcgggcgaggccggagtcatccgggcagcccatcgcaaagtgcggcacgagttgggcattgagnnnnnncgggcgggtgaaatgcacgtgatgggccggttcatctaccaagcccggnnntccgacccggtttgggttgagcacgagctggactatgccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 760 - DNA, 3426 bp, Artificial Sequence
  Description of Artificial Sequence: Synthetic polynucleotide
  modified_base (48)..(48): a, c, t, g, unknown or other
  modified_base (52)..(52): a, c, t, g, unknown or other
  modified_base (63)..(63): a, c, t, g, unknown or other
  modified_base (84)..(84): a, c, t, g, unknown or other
  modified_base (103)..(103): a, c, t, g, unknown or other
  modified_base (105)..(105): a, c, t, g, unknown or other
  modified_base (117)..(118): a, c, t, g, unknown or other
  modified_base (129)..(129): a, c, t, g, unknown or other
  modified_base (366)..(366): a, c, t, g, unknown or other
  modified_base (467)..(468): a, c, t, g, unknown or other
  modified_base (472)..(472): a, c, t, g, unknown or other
  modified_base (474)..(474): a, c, t, g, unknown or other
  modified_base (624)..(624): a, c, t, g, unknown or other
  modified_base (1191)..(1191): a, c, t, g, unknown or other
  modified_base (1308)..(1308): a, c, t, g, unknown or other
  modified_base (1509)..(1509): a, c, t, g, unknown or other
  modified_base (1653)..(1653): a, c, t, g, unknown or other
  modified_base (1791)..(1791): a, c, t, g, unknown or other
  modified_base (1968)..(1968): a, c, t, g, unknown or other
  modified_base (1980)..(1980): a, c, t, g, unknown or other
  modified_base (2023)..(2025): a, c, t, g, unknown or other
  modified_base (2047)..(2049): a, c, t, g, unknown or other
  modified_base (2269)..(2269): a, c, t, g, unknown or other
  modified_base (2313)..(2313): a, c, t, g, unknown or other
  modified_base (2355)..(2355): a, c, t, g, unknown or other
  modified_base (2544)..(2544): a, c, t, g, unknown or other
  modified_base (2728)..(2729): a, c, t, g, unknown or other
  modified_base (2733)..(2733): a, c, t, g, unknown or other
  modified_base (2865)..(2866): a, c, t, g, unknown or other
  modified_base (2868)..(2868): a, c, t, g, unknown or other
  modified_base (2871)..(2871): a, c, t, g, unknown or other
  modified_base (2977)..(3426): a, c, t, g, unknown or other
atgcctaaattagaagttgtttcggagcgtataaatttctcagaggangagngcaaaattttncagaaatggcgcgatgagaanacctttcaaacatctctgnanttgagccgaggnnggaagcatttnaccttttacgatggacctccatttgcaactggacttccacactatggacacatcttggccgccacaataaaggatgttgtaaccagatgggctcacatgagcggatattacgttgaacgccgctttggttgggacactcatggacttccagtggagtttgaagtggacaagatactgggtgttaaaggacccagtgatgtgttggcgatgggcattggagcgtacaattcgaaagtncggggaattgtgatgcgttatgcggatgaatggcagcacactgttgagcggacgggccgttggatagactttgacaacgattataaaacgctttatccgtnntttntngaaacagtttggtgggttttctcgcagctatataagaaaggacttgtttaccgaggagttaaagtgatgcctttttcgactggatgttcaacacctttatccaatttcgaggccggccaaaactacaaagatgttgttgacccatcattntatgttgcatttcccatgattgatcatcctaatcgatacattattgcgtggactacaacaccatggacattgcctagcaatttggctctttgttttcaccccgacttgatatatgctgtgattttggacaagaaagagaaccgagaatatgttctgctgaaagaacgcctctctgaactgaagtctgcaaattatcaaatcctggaagagaaaaggggcattgaatttgccggcaaggagtacatgcccctttttccatacttcacacatttgaaagccgaaaggaaaattcactgcgttattacaaacacatacatcaaaactgacgctggtactggagttgttcatcaagcaccatattttggagaggacgattaccaaacatgcttggaacatggtgtgatcagcaaggattccaaaatgatttgtccagtggatgaaaaaggacattttacggaagaagtgaccgattttaagggaatctatgtgaaagatgccgacaagctcatcataaaagcattgaaggaaagggattgcttgtgaaacaagagcaacacaaacacagtntatccattttgttatcgatcgcaaacaccgctgatctacaaagcagttccttcatggttcataaaggtcgagactctagtggacaatcttctggctaacaatgagaaaacatacggngttccttcatttgtgagagacaagcgttttgccaactggttgaaagatgcccgtgactgggccgtcagcagaaatcgtttctggggcactccaattaatctatgggtcagtgaagacttcgaggaaatcatatgcccgggatcgatatccgaacttgaggaaatgactggcgccaaaattacggatctccatcgtgaacanattgatcacctcataatcacatcaaaaacgggtcatggaacactgaagcgagtcagtgaagtgttcgattgttggttcgagtccgggtccatgccttatgcgcaacagcattacccgtttgagaatgccgaagttttcgagaanaatttcccagccgatttcattgcagaagccattgatcaaacccgaggctggttctacaccctcttggtcatctcaacagcacttttcaaccgaccaccattcaagaaccttatttgtaatggacttgtgctggcctcngatggaagcaaaatgtcaaagagcaagaagaattatccagatccaatggaaattgtggagaaatatggcgctgacccacttcgtctttatctcatcaactcgccagtggttcgcggtgaaaatttgcgttttcaagaggagggagttgctgaggttatcaagcaggtcatgaatccntggttcaacgcntacaaattccttagcatggcaataaacaaatatgaagcggatnnnggaaatgaatttgtactccgcnnncattctggcttcaccaatgtgatggataaatggattctatcgttcacaaacagcttgattgcttttgtgcacaaagagatgaaggagtaccatttgtatgcggtcgtgtccccgctggtcaattattttgaggcgctcacgaacacctatattcgactgaaccgaggtcgcatcaaaggcacatcggctgacagcaaagaagaccaattattggctgccntaatacatgttctcctacaaatcacacgtcttatggcaccattnacgccattcttttgtgagtatatgtggcagaaactcaaaccnatggtagaaaaggccgaagagtctgtacatttcatgcttctaccaaaagccgagcaagagtttattgatgaagatgtggaaagacgagttgcagcagcaaggactgtgatcgaaattgtacgaacattgcgcgagcgcaaaggaataccagtcaaatatccgcttaaagaaatggttgttatcaacggnagtgcacagtttcttcaggatttgcaatcattagatggatatcttctttctgaaactaatgttgaaaagcttgtcatctcccaggacaaacacaaatatggagtccaactcaaggcagagcccaatttccgattgcttggcgcccgtctcaagggagatcagaaggctgtgacaaactatttgnngaanaaagtgaccgaagaagaactcgaaaagctcttggatgaggggaaattgacagtgcttggatatgaattgacttccgaagaagttgctgtttcgtttacaataatggactccaaaactgatgggaacaagaannanaangaaacatcgtgcgtcgttatgatcaatacgaccgaggatgatgacttgttatcaaagggacttgccagggaagtgacaaatcgagtccaaaaattgcggaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 761 - DNA, 1338 bp, Artificial Sequence
  Description of Artificial Sequence: Synthetic polynucleotide
  modified_base (1)..(69): a, c, t, g, unknown or other
  modified_base (144)..(144): a, c, t, g, unknown or other
  modified_base (186)..(186): a, c, t, g, unknown or other
  modified_base (309)..(309): a, c, t, g, unknown or other
  modified_base (348)..(348): a, c, t, g, unknown or other
  modified_base (705)..(705): a, c, t, g, unknown or other
  modified_base (1135)..(1338): a, c, t, g, unknown or other
nnnnnnnnnnnnnnnnnnnnnnnnnnnnnnnnnnnnnnnnnnnnnnnnnnnnnnnnnnnnnnnnnnnnntttatcctgaaatcttcaaaagaggaaccaaagacacacaccgaggattggccatttatttttaagaacttcganaaactgaacattcgcacttctcactacactccacttgtcganggttgttcaccattaaaacgcgacatcaaaaattacatctccgccggctacttcaatttggacaaacccagcaatccgtccagtcatgaagttgtggcttgggtcaaacgaattctgcgcgtncagaaaaccgggcacagtggcaccttggatccgaaagtntctggtgttctgattgtatgcattgaccgtacaactcgcctggccaagtcacagcagaacgcagggaaggaatatgttgccatcttcaagctgcacaatccagtcaagtccgagaagacaatcaagcaagcattggataagcttactggcgcattgttccaacgccctccactgatctcagcagtcaagcgacaacttcgaattcggacagtttatgagtgcaaattgatcgagtacaatccggcacaacaaatgggaatttattggatgagctgcgaggcaggcacttatgttcgtacccatgttgtccatcttggcctgatgcttggtgttggcgcgcaaatgcaggaattgagncgtgttcgctcgggagtcacctccgagaatgaccacattgtcactttgcatgacgttctcgacgcgcaatacctttacgaccacaacaaggacgagagctaccttcgtcgcatcattcgtccattggaggctctcctggttcagcacaaaaggcttgtcgtcaaggacagttcggtgaatgccatttgctatggggccaaaatattgctgcccggaatattgcgctatgagaatggcattgagctgaatgatgagattgtggttgtcagcacaaagggggaggccgtttgcattgctatcgctttgatgaccacctccaccattgcagtcactgaccatgggattgtggcgaaaataaagcgagtgatcatggagcgagacacttatgcgcgcaaatggggccttgggccagtggcgtcaaagaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 762 - DNA, 1494 bp, Artificial Sequence
  Description of Artificial Sequence: Synthetic polynucleotide
  modified_base (1)..(90): a, c, t, g, unknown or other
  modified_base (273)..(273): a, c, t, g, unknown or other
  modified_base (318)..(318): a, c, t, g, unknown or other
  modified_base (327)..(328): a, c, t, g, unknown or other
  modified_base (340)..(342): a, c, t, g, unknown or other
  modified_base (348)..(348): a, c, t, g, unknown or other
  modified_base (351)..(351): a, c, t, g, unknown or other
  modified_base (355)..(355): a, c, t, g, unknown or other
  modified_base (358)..(358): a, c, t, g, unknown or other
  modified_base (360)..(362): a, c, t, g, unknown or other
  modified_base (364)..(364): a, c, t, g, unknown or other
  modified_base (366)..(366): a, c, t, g, unknown or other
  modified_base (370)..(370): a, c, t, g, unknown or other
  modified_base (372)..(372): a, c, t, g, unknown or other
  modified_base (374)..(375): a, c, t, g, unknown or other
  modified_base (377)..(378): a, c, t, g, unknown or other
  modified_base (380)..(380): a, c, t, g, unknown or other
  modified_base (460)..(462): a, c, t, g, unknown or other
  modified_base (468)..(468): a, c, t, g, unknown or other
  modified_base (476)..(478): a, c, t, g, unknown or other
  modified_base (480)..(480): a, c, t, g, unknown or other
  modified_base (483)..(484): a, c, t, g, unknown or other
  modified_base (487)..(487): a, c, t, g, unknown or other
  modified_base (489)..(493): a, c, t, g, unknown or other
  modified_base (496)..(498): a, c, t, g, unknown or other
  modified_base (500)..(505): a, c, t, g, unknown or other
  modified_base (507)..(509): a, c, t, g, unknown or other
  modified_base (512)..(517): a, c, t, g, unknown or other
  modified_base (520)..(521): a, c, t, g, unknown or other
  modified_base (524)..(525): a, c, t, g, unknown or other
  modified_base (527)..(527): a, c, t, g, unknown or other
  modified_base (530)..(530): a, c, t, g, unknown or other
  modified_base (534)..(536): a, c, t, g, unknown or other
  modified_base (540)..(544): a, c, t, g, unknown or other
  modified_base (546)..(546): a, c, t, g, unknown or other
  modified_base (548)..(549): a, c, t, g, unknown or other
  modified_base (552)..(552): a, c, t, g, unknown or other
  modified_base (555)..(556): a, c, t, g, unknown or other
  modified_base (558)..(563): a, c, t, g, unknown or other
  modified_base (567)..(567): a, c, t, g, unknown or other
  modified_base (571)..(574): a, c, t, g, unknown or other
  modified_base (580)..(580): a, c, t, g, unknown or other
  modified_base (582)..(583): a, c, t, g, unknown or other
  modified_base (585)..(585): a, c, t, g, unknown or other
  modified_base (589)..(590): a, c, t, g, unknown or other
  modified_base (593)..(593): a, c, t, g, unknown or other
  modified_base (595)..(597): a, c, t, g, unknown or other
  modified_base (600)..(601): a, c, t, g, unknown or other
  modified_base (604)..(609): a, c, t, g, unknown or other
  modified_base (612)..(613): a, c, t, g, unknown or other
  modified_base (615)..(615): a, c, t, g, unknown or other
  modified_base (621)..(621): a, c, t, g, unknown or other
  modified_base (624)..(624): a, c, t, g, unknown or other
  modified_base (627)..(627): a, c, t, g, unknown or other
  modified_base (630)..(630): a, c, t, g, unknown or other
  modified_base (639)..(640): a, c, t, g, unknown or other
  modified_base (642)..(642): a, c, t, g, unknown or other
  modified_base (644)..(647): a, c, t, g, unknown or other
  modified_base (649)..(649): a, c, t, g, unknown or other
  modified_base (651)..(651): a, c, t, g, unknown or other
  modified_base (654)..(658): a, c, t, g, unknown or other
  modified_base (660)..(660): a, c, t, g, unknown or other
  modified_base (666)..(667): a, c, t, g, unknown or other
  modified_base (675)..(676): a, c, t, g, unknown or other
  modified_base (678)..(679): a, c, t, g, unknown or other
  modified_base (681)..(681): a, c, t, g, unknown or other
  modified_base (684)..(684): a, c, t, g, unknown or other
  modified_base (693)..(697): a, c, t, g, unknown or other
  modified_base (699)..(702): a, c, t, g, unknown or other
  modified_base (704)..(704): a, c, t, g, unknown or other
  modified_base (708)..(709): a, c, t, g, unknown or other
  modified_base (711)..(712): a, c, t, g, unknown or other
  modified_base (717)..(717): a, c, t, g, unknown or other
  modified_base (720)..(720): a, c, t, g, unknown or other
  modified_base (723)..(723): a, c, t, g, unknown or other
  modified_base (727)..(728): a, c, t, g, unknown or other
  modified_base (732)..(732): a, c, t, g, unknown or other
  modified_base (735)..(735): a, c, t, g, unknown or other
  modified_base (797)..(800): a, c, t, g, unknown or other
  modified_base (802)..(808): a, c, t, g, unknown or other
  modified_base (810)..(812): a, c, t, g, unknown or other
  modified_base (814)..(815): a, c, t, g, unknown or other
  modified_base (817)..(824): a, c, t, g, unknown or other
  modified_base (826)..(826): a, c, t, g, unknown or other
  modified_base (829)..(832): a, c, t, g, unknown or other
  modified_base (835)..(835): a, c, t, g, unknown or other
  modified_base (837)..(837): a, c, t, g, unknown or other
  modified_base (846)..(846): a, c, t, g, unknown or other
  modified_base (864)..(866): a, c, t, g, unknown or other
  modified_base (873)..(873): a, c, t, g, unknown or other
  modified_base (888)..(888): a, c, t, g, unknown or other
  modified_base (891)..(891): a, c, t, g, unknown or other
  modified_base (901)..(901): a, c, t, g, unknown or other
  modified_base (906)..(908): a, c, t, g, unknown or other
  modified_base (915)..(915): a, c, t, g, unknown or other
  modified_base (921)..(924): a, c, t, g, unknown or other
  modified_base (928)..(928): a, c, t, g, unknown or other
  modified_base (930)..(933): a, c, t, g, unknown or other
  modified_base (935)..(936): a, c, t, g, unknown or other
  modified_base (941)..(942): a, c, t, g, unknown or other
  modified_base (951)..(951): a, c, t, g, unknown or other
  modified_base (954)..(954): a, c, t, g, unknown or other
  modified_base (957)..(957): a, c, t, g, unknown or other
  modified_base (960)..(961): a, c, t, g, unknown or other
  modified_base (963)..(963): a, c, t, g, unknown or other
  modified_base (967)..(969): a, c, t, g, unknown or other
  modified_base (971)..(971): a, c, t, g, unknown or other
  modified_base (973)..(973): a, c, t, g, unknown or other
  modified_base (975)..(975): a, c, t, g, unknown or other
  modified_base (977)..(978): a, c, t, g, unknown or other
  modified_base (983)..(987): a, c, t, g, unknown or other
  modified_base (989)..(990): a, c, t, g, unknown or other
  modified_base (994)..(994): a, c, t, g, unknown or other
  modified_base (996)..(996): a, c, t, g, unknown or other
  modified_base (1003)..(1004): a, c, t, g, unknown or other
  modified_base (1006)..(1007): a, c, t, g, unknown or other
  modified_base (1009)..(1009): a, c, t, g, unknown or other
  modified_base (1012)..(1012): a, c, t, g, unknown or other
  modified_base (1014)..(1014): a, c, t, g, unknown or other
  modified_base (1020)..(1021): a, c, t, g, unknown or other
  modified_base (1023)..(1024): a, c, t, g, unknown or other
  modified_base (1026)..(1026): a, c, t, g, unknown or other
  modified_base (1028)..(1029): a, c, t, g, unknown or other
  modified_base (1032)..(1034): a, c, t, g, unknown or other
  modified_base (1040)..(1040): a, c, t, g, unknown or other
  modified_base (1044)..(1050): a, c, t, g, unknown or other
  modified_base (1053)..(1055): a, c, t, g, unknown or other
  modified_base (1062)..(1063): a, c, t, g, unknown or other
  modified_base (1065)..(1065): a, c, t, g, unknown or other
  modified_base (1075)..(1076): a, c, t, g, unknown or other
  modified_base (1078)..(1078): a, c, t, g, unknown or other
  modified_base (1081)..(1083): a, c, t, g, unknown or other
  modified_base (1086)..(1086): a, c, t, g, unknown or other
  modified_base (1088)..(1089): a, c, t, g, unknown or other
  modified_base (1092)..(1092): a, c, t, g, unknown or other
  modified_base (1096)..(1097): a, c, t, g, unknown or other
  modified_base (1099)..(1100): a, c, t, g, unknown or other
  modified_base (1105)..(1107): a, c, t, g, unknown or other
  modified_base (1110)..(1110): a, c, t, g, unknown or other
  modified_base (1113)..(1113): a, c, t, g, unknown or other
  modified_base (1115)..(1116): a, c, t, g, unknown or other
  modified_base (1120)..(1120): a, c, t, g, unknown or other
  modified_base (1122)..(1125): a, c, t, g, unknown or other
  modified_base (1128)..(1128): a, c, t, g, unknown or other
  modified_base (1131)..(1132): a, c, t, g, unknown or other
  modified_base (1134)..(1134): a, c, t, g, unknown or other
  modified_base (1137)..(1137): a, c, t, g, unknown or other
  modified_base (1143)..(1144): a, c, t, g, unknown or other
  modified_base (1152)..(1152): a, c, t, g, unknown or other
  modified_base (1156)..(1157): a, c, t, g, unknown or other
  modified_base (1161)..(1164): a, c, t, g, unknown or other
  modified_base (1167)..(1167): a, c, t, g, unknown or other
  modified_base (1170)..(1171): a, c, t, g, unknown or other
  modified_base (1173)..(1173): a, c, t, g, unknown or other
  modified_base (1175)..(1177): a, c, t, g, unknown or other
  modified_base (1180)..(1184): a, c, t, g, unknown or other
  modified_base (1186)..(1194): a, c, t, g, unknown or other
  modified_base (1198)..(1198): a, c, t, g, unknown or other
  modified_base (1203)..(1208): a, c, t, g, unknown or other
  modified_base (1210)..(1211): a, c, t, g, unknown or other
  modified_base (1213)..(1230): a, c, t, g, unknown or other
  modified_base (1232)..(1237): a, c, t, g, unknown or other
  modified_base (1242)..(1248): a, c, t, g, unknown or other
  modified_base (1252)..(1252): a, c, t, g, unknown or other
  modified_base (1260)..(1261): a, c, t, g, unknown or other
  modified_base (1263)..(1266): a, c, t, g, unknown or other
  modified_base (1268)..(1272): a, c, t, g, unknown or other
  modified_base (1276)..(1277): a, c, t, g, unknown or other
  modified_base (1279)..(1280): a, c, t, g, unknown or other
  modified_base (1344)..(1344): a, c, t, g, unknown or other
  modified_base (1464)..(1464): a, c, t, g, unknown or other
  modified_base (1492)..(1494): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagttccgaggaatggaagtcgtccacgaagagggagacgtacactttgttggagcaagagttgggcaggctgctggcgacggcaccggccgagaagaaggactattggtacaaggagttcgaaaacttcaaggcccttttcgcccgctttctgcgcgccaagacaaccattgactggaanaaaatccagccccttcccgagggctccataattccctattcgatnctcggcacnnccatgggctgcnnnggcccnaantcgntgntnnngntncgcnangnncnnantttcctcgactttgcccttggccagcacaaaattttgaatgggaaatatggtgcagatgttccactgttgttgatgaacnnnttcaanacggatgnnnanacnnagnannnnntgnnnannnnnncnnntgnnnnnnttnnggnncnctncttnnnccannnnngntnnccncgnntnnnnnncgantccnnnntgccantnncncggnnttngnnnganngtnnnnnnganngntggtanccnccnggncatggcaanntntnnnncncnttnnnnnanagtggnntgctggannanntnctngcccagggnnnnnannnngntttnntnncgaanatnganaacnngggngcnacggttgacccgaacatcctcaactacatggccgccaggggggtccgagttcatcatggagnnnncnnnnnnnannngnncnnnnnnnnanggnnnnacntnaagggtggnacattgattgaattcgannnccgtttnatgcttctggaatgngcncaagtgccgnctgannntgttgangaattnnnntcgntnnnnannttcannatattcaanacnaanaanntntggnnnantntngnngctgnnnnncnntgcntngtggccnncnngntgnanatgganntnntngnnaannnaaagcntctnnnnnnnggnnntgatgtnntncagctggaanngnccnnnggngnngcnatcnngnncttcnnnggngcntnngctntnnnngtnccnngntcncgcttnntgccagtnaagnnaacnnnnganttnntncnnntgnnnnncnnnnnnnnngacntcgannnnnncnntnnnnnnnnnnnnnnnnnncnnnnnntcccnnnnnnncctntggtcaanntnnnnannnnntttnncnnagtcaaagagttcctgaagcgcttccaaggcatcccggatttgctggagctggaccatttgacngtgtcgggtgacgtttggtttggcagggatgtgacactgaagggcactgtcatcataattgccaaccacggggatcgcattgacattccccccggcacaatcctcgaaaacaaaattgantcaggcaatctgcgcatacttgaccatnnn

SEQ ID NO: 763 - DNA, 1059 bp, Artificial Sequence
  Description of Artificial Sequence: Synthetic polynucleotide
  modified_base (1)..(162): a, c, t, g, unknown or other
  modified_base (249)..(249): a, c, t, g, unknown or other
  modified_base (600)..(600): a, c, t, g, unknown or other
  modified_base (621)..(621): a, c, t, g, unknown or other
  modified_base (644)..(644): a, c, t, g, unknown or other
  modified_base (651)..(651): a, c, t, g, unknown or other
  modified_base (657)..(658): a, c, t, g, unknown or other
  modified_base (663)..(666): a, c, t, g, unknown or other
  modified_base (711)..(711): a, c, t, g, unknown or other
  modified_base (814)..(816): a, c, t, g, unknown or other
  modified_base (838)..(840): a, c, t, g, unknown or other
  modified_base (946)..(1059): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagccaacaaatggaccgatcgagagcgcgttctgctgctctgttcgcgcggctcgctggcacgaactcgccacctcgtcaatganttaaagcggctgatgcctcacacccattccgagtccaaatacgggaagaacggcaacatggatgatttgaacgagatgtgcgagctgtccaattgcaccaaatgcatttacttcgaaagccgcaaagggcgggatgtttacatgtgggcctccaatgtggatggcggaccttcggcaaaatttctggtaaaaaacatgcacacaatgacggagttgcacatgattgggaactgcttgaaaggctcccgaccaatcctctccttcgatccgaagtttgatgaggagccatatttgcgactgatcaaggagctttttgttaatactttcaaaacgcccaacttccatcctcgnagccagccattcattgaccangtgttcaactttgctgtctccanagatggnaatatnnggttnnnnaattaccagattgttgatggcaaggaggagcttcaggaaattgtncctcgctttgtgctccaaccaatccgcatcttcgatggctctttctgcggcactgtgctctacgacaacccagagtaccaaagccccaacctcatccgacggnnncacctgaaattccaaaaggccnnnttagagttgaagcagcgacaggagcaaaaggaggagcgcgcggtcaaggaggaaatggtgcgctccgtgaagctggacgacccaattggcgagattttcgacacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 764 - DNA, 1719 bp, Artificial Sequence
  Description of Artificial Sequence: Synthetic polynucleotide
  modified_base (1)..(135): a, c, t, g, unknown or other
  modified_base (181)..(183): a, c, t, g, unknown or other
  modified_base (427)..(429): a, c, t, g, unknown or other
  modified_base (438)..(438): a, c, t, g, unknown or other
  modified_base (646)..(648): a, c, t, g, unknown or other
  modified_base (768)..(768): a, c, t, g, unknown or other
  modified_base (771)..(771): a, c, t, g, unknown or other
  modified_base (795)..(795): a, c, t, g, unknown or other
  modified_base (843)..(843): a, c, t, g, unknown or other
  modified_base (853)..(853): a, c, t, g, unknown or other
  modified_base (855)..(855): a, c, t, g, unknown or other
  modified_base (1009)..(1009): a, c, t, g, unknown or other
  modified_base (1012)..(1012): a, c, t, g, unknown or other
  modified_base (1015)..(1015): a, c, t, g, unknown or other
  modified_base (1173)..(1173): a, c, t, g, unknown or other
  modified_base (1261)..(1263): a, c, t, g, unknown or other
  modified_base (1474)..(1476): a, c, t, g, unknown or other
  modified_base (1570)..(1572): a, c, t, g, unknown or other
  modified_base (1651)..(1719): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaagaggatccctcctccccgtccgaatacttccgaatgcggnnngacatgatcgagtcgagacgcgccgccggcgacaacccgttcccgcacaagttcgacgtgtccatctcgctgcaagacttcatcgacaagtacaccctgactgagaagggcaaaatgctggaggatgtgttatcggatttaggtcgcatctatctgaaacgtgagcaaggctccaagctcatcttctatgatctccatggcgagtgcaaaaagatccaaattctggcgaatgcaaagtaccacnnnggcctcgangacttcataaccacccatgaccgaatcaaacggggggacattgtcgccgtcgaggggcacccgtcccggtcgaacacgggcgagctgagtgtggtcccgattgggatgtggttgctgacgccatgcttgcggatgctgccacgctcacattttggcattaagaacattgatgttcggtaccgaatgcgctttctcgacctgatcgtgnnnccacaagtccgtgagaaattcgttgttcgtgccaagatcatcacattcctgcgcaaatacctggatgagcttggcttcctcgaggtggaaaccccaatcatgaaccaaattgcgggaggngcnacggcaaaaccgttcatcacacancacaacgagttggacatgaacctgtacttgcgagtggcgcctgaactntatcataagntncttgtggtgggcggcattgaacgtgtctacgagattggacgtctgttccgcaacgagggcattgaccaaacccacaacccagagttcacctcctgcgagttctacatggcctacgcggactaccgggacttgatggatttgaccgaggatttgnttncanaaatggtgatgagcattcacggcacctacaagctcaaataccatccgaacgggcccggcacccaaccagtctacgatgtggatttcacaccgcccttcaaacgtaaattcattctttattttttggaaatgaatttaaaaattcaggttgttacattnttaaatgtaaattttaaagatgcccgcaatttcttcatcaaaattgccgaagaccgcggcattgactgccccgagcccaaaaccacgnnncgtctgctggacaagctggtcggcgaactgctcgagccccggttcatcagccccaccttcctggtcggccatccccaaatcatgtccccgctggccaagtggcatcgccaattcgatggattgaccgaacgctttgaactgttcgtggtgaccaaggagatttgcaacgcgtacaccgaactgaacgacccaatcatccagcgggcccggnnngagcagcaagcgaaggacaaggaggccggtgatgatgaggcccaggtggtggacgagactttctgcacggcactggagtacgggctgccgccannngcgggctggggaatgggcatcgatcggctgtcgatgatcttcacggacagccacaacatcaaggaggttggaatgtttnnnnnnnnnnnnnnnnnnnnnnnnnnnnnnnnnnnnnnnnnnnnnnnnnnnnnnnnnnnnnnnnnnnnn

SEQ ID NO: 765 - DNA, 1596 bp, Artificial Sequence
  Description of Artificial Sequence: Synthetic polynucleotide
  modified_base (1)..(21): a, c, t, g, unknown or other
  modified_base (64)..(66): a, c, t, g, unknown or other
  modified_base (174)..(174): a, c, t, g, unknown or other
  modified_base (192)..(192): a, c, t, g, unknown or other
  modified_base (259)..(259): a, c, t, g, unknown or other
  modified_base (291)..(291): a, c, t, g, unknown or other
  modified_base (324)..(324): a, c, t, g, unknown or other
  modified_base (330)..(330): a, c, t, g, unknown or other
  modified_base (336)..(336): a, c, t, g, unknown or other
  modified_base (351)..(351): a, c, t, g, unknown or other
  modified_base (366)..(366): a, c, t, g, unknown or other
  modified_base (371)..(372): a, c, t, g, unknown or other
  modified_base (514)..(540): a, c, t, g, unknown or other
  modified_base (757)..(1035): a, c, t, g, unknown or other
  modified_base (1119)..(1119): a, c, t, g, unknown or other
  modified_base (1279)..(1596): a, c, t, g, unknown or other
nnnnnnnnnnnnnnnnnnnnncagtacactcgcggcacagctcgagttttcatctcgaagaagnnngcggtgaagaagctgcagcttagcctgaaggattttcgacgactttgcattctgaaggggatttacccacgggagcccaacaaacagaaagcaaacaagggtggaagnacgcagaacaagattttntaccatctccgcgacatcaacttccttgcccaagagccgctgcttcaaaagtttcgggaatacaagnttttcctgcgcaaagtgagccatgcacgggcnaagaagaacaacgagcaagtgaacagcctgctncagcgnaaaccncggtttacctatgancacattgtgaaaganaggtnnccaaccttctcgtctgcccttcgcgacctggacgacgccctctgtctgtgctttgcattcgccaacctggcccagtccaaagtggccccgcatggactcattgagagaagcaagcggctggtcaccgagttcatgcattttnnnnnnnnnnnnnnnnnnnnnnnnnnngtgttcatttccatcaagggcatctactaccaggccgaagtgatgggcgaacgcgtcacctggctggtcggccacgagcgaggggtgggacgggcgaatgagctggactttacgacaatgaccaactttgtggagttctacacgtgcatgctggccttcgtgaactaccggctgttcaagtccatcgggctgttctatccgcccctgttgcagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccgggcggcatcaccgaggccagcgagctgatcacccaccaggttgtggaccggccaatgcagaagatggacttgaacggngtgtacatccagccccaatgggtgtttgactgcttcaacgggcggcgcctgctaccggccgtcaggtacgcgcccgcggccaccctgccgccccatctttcgccattcgttgacgaacacgccgtcgatcaaatcccagtggagcgattggaggctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 766 - DNA, 276 bp, Artificial Sequence
  Description of Artificial Sequence: Synthetic polynucleotide
  modified_base (1)..(9): a, c, t, g, unknown or other
  modified_base (213)..(213): a, c, t, g, unknown or other
  modified_base (274)..(276): a, c, t, g, unknown or other
nnnnnnnnntcaaccgcaacaaatccatcgacgctactaccgcttgaactcatcgacaaatgtgttggcagtcggatttgggttatcatgaaaattgagaaagaaattgtgggcaccttaattggttttgatgactacgtcaacatggtgttggaagatgtggtcgaatacgaaacaacagccgaaggcaaacgcgtcacaaagctggacacnattttgctaaatgggaaccacatcaccatgttggtgcccggaggagagggacccgaaattnnn

SEQ ID NO: 767 - DNA, 315 bp, Artificial Sequence
  Description of Artificial Sequence: Synthetic polynucleotide
  modified_base (1)..(18): a, c, t, g, unknown or other
  modified_base (102)..(102): a, c, t, g, unknown or other
  modified_base (237)..(237): a, c, t, g, unknown or other
  modified_base (310)..(315): a, c, t, g, unknown or other
nnnnnnnnnnnnnnnnnnaaaaagaaaaaggaaagcattgtggatctttccagatttattgacaaaacggtgcgcgttaaattccagggtggccgtgaaccngccggtgttctcaaaggctatgatgctttgttgaatttggtcttggataatgctgttgaatttttgcgtgaatcagacgatcctttgaagacaaccgaagagacacgaaatcttgggctgatcgttgcacgggcnacagcaataactgtggtggcgccaaacgtcgggatcgaacaaatcgcaaatccatttttgtcagctggagagnnnnnn

SEQ ID NO: 768 - DNA, 387 bp, Artificial Sequence
  Description of Artificial Sequence: Synthetic polynucleotide
  modified_base (1)..(24): a, c, t, g, unknown or other
  modified_base (105)..(106): a, c, t, g, unknown or other
  modified_base (108)..(109): a, c, t, g, unknown or other
  modified_base (112)..(112): a, c, t, g, unknown or other
  modified_base (114)..(117): a, c, t, g, unknown or other
  modified_base (120)..(123): a, c, t, g, unknown or other
  modified_base (125)..(126): a, c, t, g, unknown or other
  modified_base (128)..(130): a, c, t, g, unknown or other
  modified_base (283)..(283): a, c, t, g, unknown or other
  modified_base (285)..(285): a, c, t, g, unknown or other
  modified_base (287)..(287): a, c, t, g, unknown or other
  modified_base (289)..(293): a, c, t, g, unknown or other
  modified_base (385)..(387): a, c, t, g, unknown or other
nnnnnnnnnnnnnnnnnnnnnnnncaggcatatcctttggccgatattcagctatcgcagaaattgcttgacattgttcagcaagctctaaactatcatcaactnnannaangnnnnaannnngnnannnaaacattaaatcgtggaatttccgagctgattgtcttggcagctgatgccgagcctcttgagatcattctgcacttgccgcttctctgcgaggacaagaatgttccatatgtgttcgtgaaaagcaaagcggctctgggacgtgcttgcggtntnancnnnnnggtcgttgctgcttcaatcacgcagaatgaaggctcacagctgaagtcacaaattcagaagattaaggaagatgttgagaagctgctcatcnnn

SEQ ID NO: 769 - DNA, 1335 bp, Artificial Sequence
  Description of Artificial Sequence: Synthetic polynucleotide
  modified_base (1)..(213): a, c, t, g, unknown or other
  modified_base (411)..(411): a, c, t, g, unknown or other
  modified_base (453)..(453): a, c, t, g, unknown or other
  modified_base (483)..(483): a, c, t, g, unknown or other
  modified_base (510)..(510): a, c, t, g, unknown or other
  modified_base (546)..(546): a, c, t, g, unknown or other
  modified_base (573)..(573): a, c, t, g, unknown or other
  modified_base (588)..(588): a, c, t, g, unknown or other
  modified_base (591)..(591): a, c, t, g, unknown or other
  modified_base (600)..(600): a, c, t, g, unknown or other
  modified_base (621)..(621): a, c, t, g, unknown or other
  modified_base (648)..(648): a, c, t, g, unknown or other
  modified_base (714)..(714): a, c, t, g, unknown or other
  modified_base (753)..(753): a, c, t, g, unknown or other
  modified_base (768)..(768): a, c, t, g, unknown or other
  modified_base (777)..(777): a, c, t, g, unknown or other
  modified_base (798)..(798): a, c, t, g, unknown or other
  modified_base (807)..(807): a, c, t, g, unknown or other
  modified_base (813)..(813): a, c, t, g, unknown or other
  modified_base (882)..(882): a, c, t, g, unknown or other
  modified_base (972)..(972): a, c, t, g, unknown or other
  modified_base (1333)..(1335): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatgactgagattaatttattgcaaccagtggatcaacaattcaaagatggaaactatccactcggacagtttaagatttgtgagtatcgcattgataaagatgatcgaaccgcaataaatcgcatgacaaatgaggagaagaaggcattggacagcagctatgaagaaatttacaaggacttcaggcgtgccgcngaatcgcacagacaaactcgtgcgtatgtgaagtcatgggtnaagccagggatgaaactcatcgacatatgngaacgacttgaagcacacagtcgtcgnatgatcaacgagtctggtctcaaagctggtcttgcntttccaacgggttgttcagtcaaccantgtgccgcacattanacnccaaatgcnggtgatgaaactgtattaggntcctcagatgttgtgaagattgattanggaacccacgtgaatggtcggattattgactgcgcgttcacttttacatttgactacaaatttganacgctgttaaatgcagtgaaggaagcaacagaaactggnatccgtgaagccggnattgatgtncgactttgtgatgttggagangcaattgangaggtnatgacttcatacgaattagagctcaatggaaagacctatccgatcaagccgatacgaaatctcaatgtncattcaattggccaatatcgcattcacgctggcaagactgtcccaatcgtcaagggtggtgagcaagtgaagatggaagagaatgaactntttgccattgaaacattcggaagcactggcaagggttatgtgcacgacgatatggagacaagccattacatgaagaatttcgatctacacgatgaacacatcccattgagattggcacgaagcaagaagctgctgaacacaatcaacaagaatttcgggacactggccttttgccgacgttggcttgatcgtcttggggaaagcaaatatttgatgtcgctgaaggatctttgtgataaggacattgtgacgccatatcctccgctgtgtgaccagaaaggatgctatacagcccagtgggagcacaccattttgttgcgcccaacatgcaaggaggtggtcagtcgaggagaagattatnnn

SEQ ID NO: 770 - DNA, 2646 bp, Artificial Sequence
  Description of Artificial Sequence: Synthetic polynucleotide
  modified_base (1)..(414): a, c, t, g, unknown or other
  modified_base (517)..(702): a, c, t, g, unknown or other
  modified_base (850)..(876): a, c, t, g, unknown or other
  modified_base (1017)..(1017): a, c, t, g, unknown or other
  modified_base (1020)..(1027): a, c, t, g, unknown or other
  modified_base (1166)..(1166): a, c, t, g, unknown or other
  modified_base (1168)..(1168): a, c, t, g, unknown or other
  modified_base (1170)..(1170): a, c, t, g, unknown or other
  modified_base (1210)..(1212): a, c, t, g, unknown or other
  modified_base (1470)..(1470): a, c, t, g, unknown or other
  modified_base (1579)..(1824): a, c, t, g, unknown or other
  modified_base (2023)..(2034): a, c, t, g, unknown or other
  modified_base (2128)..(2130): a, c, t, g, unknown or other
  modified_base (2192)..(2193): a, c, t, g, unknown or other
  modified_base (2196)..(2196): a, c, t, g, unknown or other
  modified_base (2473)..(2646): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgaggacatcccaattgatttgctggagaacatgcgcgatcggagcacccgtgaccattgcagtgatgaggcggttgggcgggagattgcaagaaggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaccaaggcgccacctcggtggtcacctccatcttcccatggtacggccgtgtcaccaacgaggtgaaagtgcgcatcaagaatttgccggccgaagaggagatccgtctgcttcgacaaatccacttgaacatgctgatccgannnnnnnnnnnnnnnnnnnnnnnnnnnggaattctcccccaactgagcgtgctcaaatacgactgcaaatcctgctcctacgtgctcgggccgtttgtgcagcgccaggatgaggagaccaagcccagcacttgtccagcttgtcaaagtcgcgggccgtttgagttnaannnnnnnnagacagtctaccacaactaccagcgcatcacaatccaagagagtccaaacctggtggctgccggccgtttgccgcgttccaaggaagtgattttgttgggcgatttgtgcgactcgtgcaaacccggggatgaaattgnantnaccggcatctacaccaacagctacgacggctccctcaacnnncgccaaggctttcccgtgttcaacaccgtcatcgtggccaaccacatcgtgaagaaggaccgcatcgagtcggactcgctcaccgacgaggacatcaaggccatccaggagctggccaagcacccgcaaattgcgcagcgcgtctttgccagcattgcgcccaccatctatggacatgaggaggtgaagcaggccatcgggttggccctgttccggggcgaggcgaagaacccgcaggggaagcatagcatccgagtngacatcaacgtgctgctgtgcggtgacccgggcactgcaaagtcccaattcctgcgctacgtcgcccatctggccccccgtgccattctcaccaccggccaaggcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggccgctacgactcctcgcgcacattcgccgccaacgtggacctgaccgagccaattctgagccgcttcgacattctctgcgtcatccgcgaccagccagacccgattgatgatgaacacctggccgactttgtgctcaatagtcacaagaagttgcacccggatgtgcagcgggccatcagtgagacgcaggagnnnnnnnnnnnngaatttgacccaatcactggaatcgagctgattccacacagtttgcttcgaaagtacatcatctacgcgcgcgacaacatccacccaaagctgnnnaacattgatgacgagcgcatttccaagctgtacagtgatttgcgcaaagaatctgaggtgannggntccgtggccatcacaatccgcaacgtggagtccatgatccgaatggccgaggcgcatgccaaaatgcatttgcgcagctttgtcaacgacgcagacgtgtcgatggccaccaaagtgatgctgcagtgcttcatcaacacgcaaagggcctccgttgtgcgccacatgaagaagaaattctggaagcagctgacctacaaacgggacagcaacgaattgctgctgtttgtgctgaagcagctggtgcatgagcagattgtgtacgaacgggctcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 771 - DNA, 2280 bp, Artificial Sequence
  Description of Artificial Sequence: Synthetic polynucleotide
  modified_base (168)..(168): a, c, t, g, unknown or other
  modified_base (304)..(417): a, c, t, g, unknown or other
  modified_base (489)..(489): a, c, t, g, unknown or other
  modified_base (546)..(546): a, c, t, g, unknown or other
  modified_base (570)..(570): a, c, t, g, unknown or other
  modified_base (597)..(597): a, c, t, g, unknown or other
  modified_base (693)..(693): a, c, t, g, unknown or other
  modified_base (756)..(756): a, c, t, g, unknown or other
  modified_base (988)..(1014): a, c, t, g, unknown or other
  modified_base (1129)..(1131): a, c, t, g, unknown or other
  modified_base (1258)..(1272): a, c, t, g, unknown or other
  modified_base (1425)..(1425): a, c, t, g, unknown or other
  modified_base (1458)..(1458): a, c, t, g, unknown or other
  modified_base (1461)..(1461): a, c, t, g, unknown or other
  modified_base (1467)..(1467): a, c, t, g, unknown or other
  modified_base (1470)..(1470): a, c, t, g, unknown or other
  modified_base (1473)..(1473): a, c, t, g, unknown or other
  modified_base (1494)..(1494): a, c, t, g, unknown or other
  modified_base (1630)..(1719): a, c, t, g, unknown or other
  modified_base (1837)..(1878): a, c, t, g, unknown or other
  modified_base (2049)..(2049): a, c, t, g, unknown or other
  modified_base (2167)..(2169): a, c, t, g, unknown or other
  modified_base (2278)..(2280): a, c, t, g, unknown or other
atgtcaaatttagataatccaggactttattatcagaaccgggattttgcggatgaaaacaatccagatggaggccgtgaactggtggccgaataccgacaaatggacgagcaattccaacgattcattcgcgagtttagcggcaaaggaatgacttgggtttacggngagcaattgaaacaaaactacacgcttggcgaacatcgcttggtggttcagttcaaggatttgcgtcttttcgacgaggacactgcccacaaattgcgccgttatccagccactcttttgcccgctgtaagccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaagagttcggaagtgtcccaactggtgaaagtgtcgggcatcattgtggccgcctcccaagttcgttcncgcgcaacccgtgtcactttgcaatgccgcacttgtcggcacacaatcagcaaccangagatcaagccgggcttggagcanttccagttgccgcgcaaatgcttggcnaaccaaatgggccaactccaacgctgtccaatggacccgtacacaatgatacccgacaagtgccaatgcgtggactttcaacagttgaaactgcangaattgccggaagatgtgccacatagtgagatgccacggcacatgcttgtgtatgcggaccgntatttgacggacaaagtgacgcccgggaatcgagtaacaatcactggaatttactcgattaagcgcttggccggtcgcgaagacaaagcagccggaatggctggcattcgcgcaccctacatccgtgcagttggcattgaggtacaaacaagtgggccgggacgtgccgaccaaatgcacttctcgcccgaggaagagcgacaatttaaggttttattaaatttacttgatnnnnnnnnnnnnnnnnnnnnnnnnnnntgcccgtccatttttggttcagaggacatcaaacgggccattgcttgcctgcttttcagcggttcacgaaaacggactcccgatgagctgactcgtcgtggctgacataatgtcnnnttgcttggtgatcctggcacggcaaagtctcaactgctcaaatttgtggaaaaagtggcaccaattgcggtctacacatcgggcaaaggcagcagtgcggccggtcttaccgcttcggtgattcgcnnnnnnnnnnnnnnntcattcattatggagggcggtgccatggttctggccgatggtggcattgtttgcattgatgagttcgacaaaatgcgagaggatgatcgcgtcgccattcacgaggcaatggaacagcaaacgatcagtattgccaaggccggaatcacaacnacgctgaactcgcgttgttcagtgctggccgcngcnaattcngtnttnggccgatgggatgacacccgnggcgaggagaacatcgactttatgccaaccattctgtcgcgtttcgactgcatttttgtggtcaaagatcaacatgatcgcacacgggattcgcaattggcgaaacacgttatccaagtgcacatgcatgcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcattggaattcttgaaacgctacattgcctatgcccgagccaattgtgggcctcgcatttcggagaaagccaatcaaatgctgctgaaccaatatgtgcgaatgcgtaatccannnnnnnnnnnnnnnnnnnnnnnnnnnnnnnnnnnnnnnnnncaatcgtccattccaatcactgtgcgtcaactggaggcaattgtgcgtttgagcgaggcgctggccaaaatggagctgcttccgttcgcagaggaacgacatgttgaagaagcaattcgcctcttcaaagtcagcacaattgcagcagcacaaagtggaaatttgagtgtngttgagggctttacttcacaggaggaccaagaatcattcaatcgcgtggaaaagcagctgaaaaaacgattccaggtcggcacctatgtttccgagcacttgatcattgacgaattcnnngccaagcaaggctatccggaagcgctcgttagaaaggctatcgaattttgtgtgcgccgtcaggactttgagtaccgaatgcagaggaaaatgctttatcgcttgaagnnn

SEQ ID NO: 772 - DNA, 612 bp, Artificial Sequence
  Description of Artificial Sequence: Synthetic polynucleotide
  modified_base (132)..(132): a, c, t, g, unknown or other
  modified_base (336)..(336): a, c, t, g, unknown or other
  modified_base (399)..(399): a, c, t, g, unknown or other
  modified_base (607)..(612): a, c, t, g, unknown or other
atgacggaattggcaacaaaaagttccatcacattgaaagggagtgcgcagatgatccaacaatttttccactatgggatccatagcattctctaccagcgtggcatctacccctcggacagttttaccagngagaaaaagtacggaatgactttgttggtcaacaacgacccgaaagtgcaaaaatttcttcaacctctgctggaacatgttgagatgttgttggtgaagaaacggctgaaaaaactggtcctggtgatcacggacattgcgacaaaagaggcgctggaaagatggcaattcgagattgagaccaccgcggacattgagttggtngagaacggctccgtgaacaaggacgagaagcgcataaagcaggagatatcggatgtgctcagncaaatcacggcctcggttgcttttctcccgttgctcgagaacagatgctccttcgatgtgctcatctacacctacaaggacaccgaactgccagaaggttgggccgactcaagcgaatgccacatcacggacgctgagcaggtccagttgcgctcattctctaccgccgtgcacaacgtgctcaccaaagtgcagtacaaggctgatnnnnnn

SEQ ID NO: 773 - DNA, 3081 bp, Artificial Sequence
  Description of Artificial Sequence: Synthetic polynucleotide
  modified_base (1)..(294): a, c, t, g, unknown or other
  modified_base (346)..(348): a, c, t, g, unknown or other
  modified_base (474)..(474): a, c, t, g, unknown or other
  modified_base (741)..(741): a, c, t, g, unknown or other
  modified_base (841)..(951): a, c, t, g, unknown or other
  modified_base (1068)..(1068): a, c, t, g, unknown or other
  modified_base (1074)..(1074): a, c, t, g, unknown or other
  modified_base (1089)..(1089): a, c, t, g, unknown or other
  modified_base (1125)..(1125): a, c, t, g, unknown or other
  modified_base (1200)..(1200): a, c, t, g, unknown or other
  modified_base (1393)..(1395): a, c, t, g, unknown or other
  modified_base (1771)..(1938): a, c, t, g, unknown or other
  modified_base (2221)..(2394): a, c, t, g, unknown or other
  modified_base (2924)..(2924): a, c, t, g, unknown or other
  modified_base (2961)..(2961): a, c, t, g, unknown or other
  modified_base (2970)..(2970): a, c, t, g, unknown or other
  modified_base (3079)..(3081): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctgccttccaatagatacggaatacaccccattggtgacgaaaacaggcnnngatcctgcaaagacatatcaattcaagcttgataaattccaaaaagcagcaatcaaatgtttggacaataaccaatctgtgttggtgtcggctcacacttccgctggcaaaaccgcagtcgcactntatgcaattgcattggctctccgagacaaccaaaaagtcatttatacatcaccaatcaaggcattgagcaaccagaaatacagggaattgtctgacgaatttgaggacgtcggcttggtgactggcgatgttacgctcaacccaaccgctgcttgtgtcgtgatgaccacagaaattctgcgttccatgctttaccgaggaaccgaagtaattcgggaagttggctgggtgatttttgacgaaattcactatatgcggacaaagggncgtggtgttgtttgggaggagacaatcatcttactgccagatatctgtcattatgttttcctttcggccacaatcccaaatgctaaggaatttgctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatttacagggcagtttcaaaaaagagaacttcaaaaaagcgatgggctttttgaccgaagctcagccagagggcgccaatgttcggagcagacgcagtggtggcggagaagcnacgaanaaaagcgttgtgaanatcattcggacaattcaagagaaggaaatgctgccntgtatcatcttctccttcagccggaaagaatgtgaaatgcatgcctccaacatcaagcaaattgacttcaatacnggggaagaaaaggaggcaattaaaatgattttcggcaacgcagtcaaccttctctccgaagaagatcgcagacttccacaaatcaagggagtactcccatttcttctacgtggtattggtatccaccattccggccaattgccaatcatgaaagagattgtggaaatcctcttcggcgagggcctgatcaagnnnctttttgcaacagaaacatttgccatgggagtgaatatgcccgccaaaaccgtcctcttcacatctgctcgcaaatttgatgggaccaataatcggtggatcagcagcggggaatacatccaaatgagcgggcgagctggacgccgtggcaaagacgagaagggattggtcattttgatgttggacacccaaatgagtgaggaacaagccatacagctgattaagggaaatagcgatcccctgaactcgcaattccggcttacctacaatatggtgttgaacttactccgtgtgccagaaattaatcccgaatatatgttggagaaatcgtttcaccaatggcagaactacgcatcattgcccgcccttaaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacagcttcggcattacgacaaggactatgattggggcgttctcatcaattggcgcaaaactccaaaccctttgaacccaactgacatgctctacattgtggaagtggctgtccgcgtgtcgcccgagagtgagcgccatttgccaaacttgtcgatggttcgcccaccagatgagggcacgaatggagtgatcagcgttattccattcaccttcgactgcatcaccgccatcagcacaattcgactgaaaatcccgcaagaaatgaccaaccagggaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttcgaccaaatctacaaagcctatcagaataaggtgcaaattgaagaagactataaagcagcaaagaagcgctacgaagatgcaaagaagctgctgcaaaaggaagaattgcaaagtcgcaaacgtgtgctccaacgcctttgctattccactgagatgacacgattacggcaaaggggaagagttgcatgcgagttgagttcagccgatgagctgcttcttactgagatgatcttctccggcactttcaatgaaatggagccagaagaagcggctgctttgcttagctgctttgtctttgaagaacggacgcccagtggcaaactttcggacaaattaagcggctatctgcgaaatatgcagacaacagccaagcaaattgccaaaatctgcaatgagtgtcgacttgaggtggacgaggagaaatatgtggagaaattcggttctggcatgatggatgttgtgcacaattggtgcagaggcgccacattcgctcagattatggaaaatacgcaaatattcgaagntagcgtaatccggtgtatgcgccgattggatgagctnctgcagganatgacaaatgcagccaaggcactgaaggaaaccaaactggtggagaaatttgacaaggcacgggaattattgaaacgcgacattgtgttctcggcctccctctatttgnnn

SEQ ID NO: 774 - DNA, 1464 bp, Artificial Sequence
  Description of Artificial Sequence: Synthetic polynucleotide
  modified_base (117)..(117): a, c, t, g, unknown or other
  modified_base (456)..(456): a, c, t, g, unknown or other
  modified_base (903)..(903): a, c, t, g, unknown or other
  modified_base (1225)..(1464): a, c, t, g, unknown or other
atgttggtactttttgaaactgctgctggatatgctttgtttaagctaactgatgaaagtttgttacaaagagttgacaacatttggaaagaatttgaaagcggacaaaatccaagnatcagtttggaactcgtctccttcaaacgttacaagtctattgccgaagcagttaataatgcaaccgaaatttcggaaggaaaattgaacaaatcactcaagcgattgttgaagaagaatgtggatcaaggcgagaaactggcagtcgaagacaccaatttgggaaagctcatcaagagcacacttgagatcaaatgtcttcacaacacggcggtctcggaattgatgcgttcaattcgcgcaaatgttgagaaactggttaatgatgaggaccaacaaattaacgcaatgcgattgggggtggcgcatgctgttggtcgctacaaagtcaagttcaanccggagaagattgacacaatgattgtgcaagctgtttccttgttggatgatcttgataaagagctgaacaactatgtgatgcgttgccgcgaatggtacggttggcattttcctgaacttggcaaactgatcactgatccacaggcctatgcaaagtgtgtcaaagcaatcgggatgaagccaaatgctcagacagcaaaactcgagacaattctacccgagaatttggtggagcaagttcgcgcagaggccgagatcagcatgggtacggatatcactgagctggatcttattcacatccgagagctttgtgatcaaatcattgagcttggtcaatatcgtgcacaattgcatgaatacttaaagaaccgaatgaatgccttggctccgaatttgaccgttctgcttggtgaattgattggcgcaaggctgatttcgaaagcagtntctctgatggcattggccaaatgtcctgcttcaacggtacaaattttgggagcggagaaggcacttttccgtgcactgaagaccaagaaggacacacctaaatatggaatcatttaccatgctcaactggtcacacaagcaggacaaaaggcaaaaggaaagattgcacgaaaacttgctgcgaaaattgcgctggcaactcgcgtagacgccctctgcgatgaatcactgggtaatcaacagggcttggatgcccgcatctacctggaacaagctataaaggaagaaaatgcacgaagtgggatcaagaaacagcgttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 775 - DNA, 2475 bp, Artificial Sequence
  Description of Artificial Sequence: Synthetic polynucleotide
  modified_base (1)..(282): a, c, t, g, unknown or other
  modified_base (433)..(609): a, c, t, g, unknown or other
  modified_base (706)..(708): a, c, t, g, unknown or other
  modified_base (1253)..(1253): a, c, t, g, unknown or other
  modified_base (1255)..(1257): a, c, t, g, unknown or other
  modified_base (1261)..(1261): a, c, t, g, unknown or other
  modified_base (1263)..(1265): a, c, t, g, unknown or other
  modified_base (1299)..(1299): a, c, t, g, unknown or other
  modified_base (1302)..(1302): a, c, t, g, unknown or other
  modified_base (1362)..(1362): a, c, t, g, unknown or other
  modified_base (1476)..(1476): a, c, t, g, unknown or other
  modified_base (1744)..(1746): a, c, t, g, unknown or other
  modified_base (2092)..(2475): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgcagttatgtccgagttgtgaccggcgttgcgcatcactaccatttttcggtggccaaccatgcaggcattaagcccggagaaatcggattttcgttgccccagcgaagatggactaacgtttctttggatcaggaagttcaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatgaccaaaagccgacgacatacacgctgaaacttgttgtgaagcggatggagggcgcaacactgaattctccgcctcaagaggtttttaacnnntaataagtaaatttaatattctttccaactctgcagaccaatcttggcccgttgagtcccaacgctgtggtcatctttgaccgatcggagaactcccaaatcaacctgattggccgcagcaagggcaagtcttcccaccgtgccctcatcaaccccgactgggacttccaacaaatgggcatcggcggactggacaaggaattctcagccatcttccgccgcgcctttgcttcccgcgtgttcccacccgaattcatcgagcagttggcaatgaaacacgtgcgtggcattcttctctacggccctccagggacgggcaaaaccctgattgcgcgtcaaattggcaaaatgttgaatgctcgagagccaaaaattgtcaatggaccagaaattttgaacaagtacgtgggcgaatcggaggccaacatgcgcaagttgttcgccgaggcggaggaagaatggcgccgctgtggatcgaattcgggcttgcacatcattatttttgatgaaatcgatgcaatctgcaagcaacgcggctcaatggncnnntcancnnncgtgcacgacacagtggtgaaccagttgctgacnaanctggacggtgttgagcaactgaacaacattctcgttattggaatgaccaacagaaagganatgattgatgaagcattgctgcgacccggtcggatggaagtccagctagagatttcacttcccgacgaaaatggtcgagttcagattctgaagattcatacagcgagaatgggngagtacaataaacttgacccaaacgtggacctgaaggacattgcccacagaacaaagaacttttccggtgctgaaatcgaaggacttgtccgtgccgcccaatcgtcggccatgaaccgattggtcaaacctggcggaaaagtgcaagccgatgaggatgccgttgacaagctgatgatcacacgtgacgattttgactacgcgctggcaaatgacataaaaccggcctttggacacaacgacgaggaattggaccgattccttggtnnnggccttgttcactggggccctccggttgcgcgagtgctggacgagggcgacttgttgatcaaagaaacagaggcgtctgatacgcgtggctttaatactttacatgaattaggtccaccaaacagcggaaagacgttcctggctgcgcgcattgcaaagaagtccgagttcccgttcatcaaagtttgttcacccgaggacatggtcggctacagcgaaaccgccaaatgtgcccaattgcgaaaggtgtttgatgatgcgtacaaatccccactgagctgcatcatcattgacaacattgaacgactgctcgactactcgcccattggtccgcgctactccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 776 - DNA, 741 bp, Artificial Sequence
  Description of Artificial Sequence: Synthetic polynucleotide
  modified_base (94)..(96): a, c, t, g, unknown or other
  modified_base (172)..(411): a, c, t, g, unknown or other
  modified_base (483)..(483): a, c, t, g, unknown or other
  modified_base (739)..(741): a, c, t, g, unknown or other
atgtcacgaggaagcagcgccggttttgatcgtcacattacgatcttttcgcctgaaggccgcgtctaccaagtcgagtacgcttcaaggcggnnncaaactcgcaatctgactgctgtgggtgtgcgcggaacggagtgtgccgtcatcgctgtgcaaaagcgcattccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctgatgatgtcctacgacgacgaggatggcgcgtcaatcttcagtgtggacccggccgggcaataccangcaatccgcggcatcggcattggcgtcaagcagcagcaagtgaacagtttcctcgagaagaagttcaagaagcgcaccaactacaccctgaaggagaccatcgagttggcgctggacgcactgcagcagtcgctgggcattgacatgaaggcggaggaggtggaagtgatcacggtgagcaacgaaaagcagaccgtcacccagctgaccaacgaggaggtggagagcgcgttcaacgccatcgccgagcgcgacnnn

SEQ ID NO: 777 - DNA, 696 bp, Artificial Sequence
  Description of Artificial Sequence: Synthetic polynucleotide
  modified_base (1)..(18): a, c, t, g, unknown or other
  modified_base (21)..(22): a, c, t, g, unknown or other
  modified_base (43)..(43): a, c, t, g, unknown or other
  modified_base (354)..(354): a, c, t, g, unknown or other
  modified_base (360)..(360): a, c, t, g, unknown or other
  modified_base (363)..(363): a, c, t, g, unknown or other
  modified_base (387)..(387): a, c, t, g, unknown or other
  modified_base (421)..(423): a, c, t, g, unknown or other
  modified_base (439)..(439): a, c, t, g, unknown or other
  modified_base (441)..(441): a, c, t, g, unknown or other
  modified_base (445)..(445): a, c, t, g, unknown or other
  modified_base (447)..(447): a, c, t, g, unknown or other
  modified_base (531)..(531): a, c, t, g, unknown or other
  modified_base (595)..(696): a, c, t, g, unknown or other
nnnnnnnnnnnnnnnnnnttnnaattctccattttcagtccanccggaaagttgatgcaaatcgagtatgccatgaatgccgtgaagaatggcccaccgtcggttggactcaaagccaagggctgtgttgtgctggccaccgaaaacatccaccccatcctgcactttcccgagcacaaaatcgacaagatcacggaacacatcggcagcgtctacagcgggatgggacccgacaatcgaatcctcgtccgccgtgcccgcaaaatcggcgtcgaatatgagcttcaatacggcgaggagatcccgatcatccagcttgtcgccaaggtggccgatgtcatgcaggagtacacncaatcnggnggagtccgcccattcggcgtctcnatgctcattggcggatgggatgcccagaaggggnnnccgctgcttttccaantngatncntcgggctcctactttgcatggaaagccgcggccattggcaagaatgacatcaacgcgaagaagttcatggagaagcgctacaangacaacatggggcaggcggacgccatccacaccgcattgctgacactgcgcgagtcttatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 778 - DNA, 747 bp, Artificial Sequence; identical to SEQ ID NO: 133
  Description of Artificial Sequence: Synthetic polynucleotide
  modified_base (225)..(225): a, c, t, g, unknown or other
  modified_base (351)..(351): a, c, t, g, unknown or other
  modified_base (561)..(561): a, c, t, g, unknown or other
  modified_base (661)..(747): a, c, t, g, unknown or other

SEQ ID NO: 779 - DNA, 720 bp, Artificial Sequence
  Description of Artificial Sequence: Synthetic polynucleotide
  modified_base (1)..(69): a, c, t, g, unknown or other
  modified_base (74)..(74): a, c, t, g, unknown or other
  modified_base (102)..(102): a, c, t, g, unknown or other
  modified_base (123)..(123): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (180)..(180): a, c, t, g, unknown or other
  modified_base (189)..(189): a, c, t, g, unknown or other
  modified_base (261)..(261): a, c, t, g, unknown or other
  modified_base (270)..(270): a, c, t, g, unknown or other
  modified_base (336)..(336): a, c, t, g, unknown or other
  modified_base (342)..(342): a, c, t, g, unknown or other
  modified_base (444)..(444): a, c, t, g, unknown or other
  modified_base (649)..(649): a, c, t, g, unknown or other
  modified_base (712)..(720): a, c, t, g, unknown or other
nnnnnnnnnnnnnnnnnnnnnnnnnnnnnnnnnnnnnnnnnnnnnnnnnnnnnnnnnnnnnnnnnnnnnaccantctgattgctgttgagacaaaagacgcngttgtcttgggcaccgactcncgcacnagnacnggcgtcttcatcgcaagtcgcgttacggacaagatcacgccactnaatgaccgnatggttcttctacgggctggcaccacttcggactctcaggcgctttctgacatcatcatctattttgccgangcatttganatcatggacgaggaaccagtcactgtccacagtgttgccatgcacgcgcgcaaattccactacaantaccgngaacaggtcgattgcagcctcattgtggctggctatgacaataagaagaaaggccaaatctactccatttcgcaaggaggctacacacagcgtcagccaatntatttcagcggaagtggcagcacgcacgtgtttggcttcatggcggaacgctacgacccaaaaatgacagtggatgaggcaaagaagatagtgaagcaagcagttttcctggcccaactgttcgacagcgcatccggtggcgtcatccacttggctgtgattgacaagaatggaacacacaagcagattctgcgtccggactcgnaggagttcccgaaagagaaggaaatccccggctatccgaacctgccacagcacatccaacagnnnnnnnnn

SEQ ID NO: 780 - DNA, 615 bp, Artificial Sequence
  Description of Artificial Sequence: Synthetic polynucleotide
  modified_base (1)..(21): a, c, t, g, unknown or other
  modified_base (44)..(45): a, c, t, g, unknown or other
  modified_base (111)..(111): a, c, t, g, unknown or other
  modified_base (198)..(198): a, c, t, g, unknown or other
  modified_base (340)..(441): a, c, t, g, unknown or other
  modified_base (613)..(615): a, c, t, g, unknown or other
nnnnnnnnnnnnnnnnnnnnnggcggcactgttatcgcaatgannagcagagatgcagtttgtgttgctacggacatgcgtcttggagaccaaagaaacaacattgcgacnaatgtctccaaggtccatcgcattgatgacaaactgttcgtcggcttatgcggatttagttgtgacactgctactgttctggacaancttaagctccataaagatctttacgaacttcgcgaggatcgtccaatgcgaccgaaaatattttccaactatctctcaacattgctctacaaacgtcgcttcgggccatatttcgtcatgccacttgttgctggtattgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatctttaggtttttggcgtccagacctcaaaaccgagcaattgaccgaagcttgtgcccagactatgatgggaatcattgagcgtgacgcttctaccggatggggagcaattgtttacacaatcaccaaggatggcgttcattctcgagctctgaaatgccgcatggatnnn

SEQ ID NO: 781 - DNA, 609 bp, Artificial Sequence
  Description of Artificial Sequence: Synthetic polynucleotide
  modified_base (1)..(225): a, c, t, g, unknown or other
  modified_base (400)..(609): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctacgaaatgcgccccaaagcggcccaacattggctgcgcaaatgcatggccgaaaatctgcgtagtgaggacttttggcgcgtcaactgcatcatcggcggatacgacacgttcaccgggaaggccgagctgtacatgattgacttctacgcgaccaacatgccaagccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 782 - DNA, 855 bp, Artificial Sequence
  Description of Artificial Sequence: Synthetic polynucleotide
  modified_base (1)..(177): a, c, t, g, unknown or other
  modified_base (292)..(396): a, c, t, g, unknown or other
  modified_base (505)..(534): a, c, t, g, unknown or other
  modified_base (721)..(855): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttcaagaagggcaccaccacactggcattcatgtacaagccaaagacggaagccgacaagggcggcatcgtggtggcggtggactcgcgcgcgactggcggcagcttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcagtctgttcgagttgcgcgaaggccgtgagatcacagtgtccgccgccagcaagtacttctccaacgtcatgtacagctaccgaaaccatgggctcagtttgnnnnnnnnnnnnnnnnnnnnnnnnnnnnnnggcccctccatctacatggtcgacgacaaggggatgcgcatcaaggcgcaatacgtgtcggtggggtcgggctcgctgggcgcctacggagtgctggacacccactacaaggaggcgatgaccgaccaggaggcgctcaccctcggccgacgcgccatcatgcacgccacctaccgggactggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 783 - DNA, 777 bp, Artificial Sequence
  Description of Artificial Sequence: Synthetic polynucleotide
  modified_base (1)..(156): a, c, t, g, unknown or other
  modified_base (312)..(312): a, c, t, g, unknown or other
  modified_base (479)..(479): a, c, t, g, unknown or other
  modified_base (501)..(501): a, c, t, g, unknown or other
  modified_base (551)..(557): a, c, t, g, unknown or other
  modified_base (559)..(559): a, c, t, g, unknown or other
  modified_base (561)..(561): a, c, t, g, unknown or other
  modified_base (570)..(570): a, c, t, g, unknown or other
  modified_base (651)..(651): a, c, t, g, unknown or other
  modified_base (736)..(777): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctagctgccatatcggggaaggatttcgttgttgtggccactgacactcgtatgagccaacaggacgtgaacattgtgacgcgcgatatcgagaagattcacattctgtaaatgggaaatactattaataattagaattttttaaattcagcntaacctgctctacaaatactgtagattcgcctcaatcagtacaaatttgcttatcagcacgaaatgtcggttgacaaatttgccatgatgttgtcacgcgtgctctattacaagcggttcttcccatacctcactgggagtatcttggctggtctgaatgacaaagntgagggcgaagtctactcatangacccagttggatgcgtaaagaaagtgacttgcgagagcggtggttctgnnnnnnnantncttcaaacnttctttgacgtaaaactcgaccagtgcacagtcgttcccgaaaagcgtgctcctgaattggacttggaggcagccaaactnttgatgcgcgatgctttccgcatggtggccgaacgcgagagcagtaccggggatggaatcaagctggtttggttgcaagctggannnnnnnnnnnnnnnnnnnnnnnnnnnnnnnnnnnnnnnnnn

SEQ ID NO: 784 - DNA, 558 bp, Artificial Sequence
  Description of Artificial Sequence: Synthetic polynucleotide
  modified_base (1)..(324): a, c, t, g, unknown or other
  modified_base (327)..(327): a, c, t, g, unknown or other
  modified_base (342)..(342): a, c, t, g, unknown or other
  modified_base (385)..(385): a, c, t, g, unknown or other
  modified_base (423)..(423): a, c, t, g, unknown or other
  modified_base (432)..(432): a, c, t, g, unknown or other
  modified_base (462)..(462): a, c, t, g, unknown or other
  modified_base (477)..(477): a, c, t, g, unknown or other
  modified_base (481)..(481): a, c, t, g, unknown or other
  modified_base (487)..(558): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagngtcagcatttggttnggcgccaacgtgatggtggaatatgagctggacgaagcgcagnagctgttgaacacccacttggagaacattcagcgaacnaataagganacggatgatgagctcgacttccttcgggancagatcaccacaacnggtntgaatnnnnnnnnnnnnnnnnnnnnnnnnnnnnnnnnnnnnnnnnnnnnnnnnnnnnnnnnnnnnnnnnnnnnnnnn

SEQ ID NO: 785 - DNA, 1254 bp, Artificial Sequence
  Description of Artificial Sequence: Synthetic polynucleotide
  modified_base (84)..(84): a, c, t, g, unknown or other
  modified_base (92)..(92): a, c, t, g, unknown or other
  modified_base (94)..(94): a, c, t, g, unknown or other
  modified_base (96)..(100): a, c, t, g, unknown or other
  modified_base (102)..(103): a, c, t, g, unknown or other
  modified_base (107)..(111): a, c, t, g, unknown or other
  modified_base (270)..(270): a, c, t, g, unknown or other
  modified_base (519)..(519): a, c, t, g, unknown or other
  modified_base (786)..(786): a, c, t, g, unknown or other
  modified_base (798)..(798): a, c, t, g, unknown or other
  modified_base (822)..(822): a, c, t, g, unknown or other
  modified_base (825)..(825): a, c, t, g, unknown or other
  modified_base (840)..(840): a, c, t, g, unknown or other
  modified_base (897)..(897): a, c, t, g, unknown or other
  modified_base (900)..(900): a, c, t, g, unknown or other
  modified_base (909)..(909): a, c, t, g, unknown or other
  modified_base (927)..(927): a, c, t, g, unknown or other
  modified_base (972)..(972): a, c, t, g, unknown or other
  modified_base (982)..(982): a, c, t, g, unknown or other
  modified_base (985)..(989): a, c, t, g, unknown or other
  modified_base (1011)..(1011): a, c, t, g, unknown or other
  modified_base (1113)..(1113): a, c, t, g, unknown or other
  modified_base (1142)..(1146): a, c, t, g, unknown or other
  modified_base (1149)..(1150): a, c, t, g, unknown or other
  modified_base (1152)..(1156): a, c, t, g, unknown or other
  modified_base (1158)..(1160): a, c, t, g, unknown or other
  modified_base (1162)..(1162): a, c, t, g, unknown or other
  modified_base (1249)..(1254): a, c, t, g, unknown or other
atgagcagcttcaaaaagcttgcgattgaccaaatcgatttaaaagggaagcgagtgctgatgcgtgtcgacttcaatgttccnattaaggntnannnnntnntaannnnnatgattaaaaattacgctaatttaattatttagtatgccattgagaaagaagcaagttccatagtgctgatgagccatttgggccgacctgatggacaacgccaagacaaatattccatgaaaccggttcacaccgagcttgaaaagctgctcaataancctgtcaaatttctcaacgattgtgttggaccagaagtcgaagcggtaacagccaatcctgagccgggtgctctcattttgctggagaattgcgctttccatgttgaggaagagggcaaagggaagtcggctactggcgaatcggtgaaagcgagcaaagaagcagttgaggcatttcgcgcatcgttgtgcaaacatggcgacatttacgtgaatgacgcgttcggcactgctcatcgagcccacagntcaatggttggctgtacgtcaatgccgcgtgtttccggttttctgatgaagaaggagctcgagtacttcgccaaagcgctggacaacccgcagcgcccgttcctggcaattctgggcggtgccaaagtggctgacaaaatccaactgatcaacaatctgctcgacaaagtcaacgcaatgattgtctgcggtggcatggccttcactttcctcaaggtgctcgatggcgttcagattggcaagtcgctcttcgatgaggagggttcnaagattgtgaancaattggtggagaaggcaaagcanaanggagtttccatccanttcccagtggactttgttgtgggcgacgagttcaaggaggacacccctcacacaacngtncaagcaaangcgggcattccggaggcnaaaatgggacttgacattggcccggaaagcacgaaacaatttgcngatgtgatcnagnnnnnaaaaacgattgtgtggaatggnccggctggagtgttcgagtggcaaaactttgcaaatggcaccaagggattgctgaacgccgtgattgaggcaacccaagcgggagcaactaccataattgcnggtggcgacacggcaacggcttgcgagannnnnaanncnnnnnannnantcagtcacgtgagcaccgggggaggcgccagtctggaacttctcgaaggcaaggtactgcccggagttgaggcactcacggatgctnnnnnn

SEQ ID NO: 786 - DNA, 1233 bp, Artificial Sequence
  Description of Artificial Sequence: Synthetic polynucleotide
  modified_base (1)..(948): a, c, t, g, unknown or other
  modified_base (1138)..(1233): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgttccctttagtttcaaccatcttctgaaagctcctttcacaattcatccaaaaactggccaagtggcaattccattggatccgaaaacagtagctgacttttcactgaatgatttgcccagggtggataagctcgcaatggaatacgaaaacacaaacaaagatgaacagaaggagaacaatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 787 - DNA, 6990 bp, Artificial Sequence
  Description of Artificial Sequence: Synthetic polynucleotide
  modified_base (1)..(57): a, c, t, g, unknown or other
  modified_base (162)..(162): a, c, t, g, unknown or other
  modified_base (532)..(532): a, c, t, g, unknown or other
  modified_base (534)..(535): a, c, t, g, unknown or other
  modified_base (537)..(537): a, c, t, g, unknown or other
  modified_base (558)..(558): a, c, t, g, unknown or other
  modified_base (564)..(564): a, c, t, g, unknown or other
  modified_base (567)..(567): a, c, t, g, unknown or other
  modified_base (576)..(576): a, c, t, g, unknown or other
  modified_base (582)..(582): a, c, t, g, unknown or other
  modified_base (605)..(605): a, c, t, g, unknown or other
  modified_base (612)..(612): a, c, t, g, unknown or other
  modified_base (619)..(619): a, c, t, g, unknown or other
  modified_base (829)..(829): a, c, t, g, unknown or other
  modified_base (831)..(831): a, c, t, g, unknown or other
  modified_base (939)..(939): a, c, t, g, unknown or other
  modified_base (1087)..(1092): a, c, t, g, unknown or other
  modified_base (1324)..(1324): a, c, t, g, unknown or other
  modified_base (1362)..(1362): a, c, t, g, unknown or other
  modified_base (1384)..(1384): a, c, t, g, unknown or other
  modified_base (1452)..(1452): a, c, t, g, unknown or other
  modified_base (1467)..(1467): a, c, t, g, unknown or other
  modified_base (1522)..(1524): a, c, t, g, unknown or other
  modified_base (1620)..(1620): a, c, t, g, unknown or other
  modified_base (1626)..(1626): a, c, t, g, unknown or other
  modified_base (1630)..(1630): a, c, t, g, unknown or other
  modified_base (1722)..(1722): a, c, t, g, unknown or other
  modified_base (1731)..(1731): a, c, t, g, unknown or other
  modified_base (1737)..(1737): a, c, t, g, unknown or other
  modified_base (1830)..(1830): a, c, t, g, unknown or other
  modified_base (1842)..(1842): a, c, t, g, unknown or other
  modified_base (1851)..(1851): a, c, t, g, unknown or other
  modified_base (1854)..(1854): a, c, t, g, unknown or other
  modified_base (1875)..(1875): a, c, t, g, unknown or other
  modified_base (1881)..(1881): a, c, t, g, unknown or other
  modified_base (1884)..(1884): a, c, t, g, unknown or other
  modified_base (1890)..(1890): a, c, t, g, unknown or other
  modified_base (1896)..(1896): a, c, t, g, unknown or other
  modified_base (1905)..(1905): a, c, t, g, unknown or other
  modified_base (1908)..(1908): a, c, t, g, unknown or other
  modified_base (1998)..(1998): a, c, t, g, unknown or other
  modified_base (2037)..(2037): a, c, t, g, unknown or other
  modified_base (2175)..(2175): a, c, t, g, unknown or other
  modified_base (2265)..(2265): a, c, t, g, unknown or other
  modified_base (2268)..(2268): a, c, t, g, unknown or other
  modified_base (2274)..(2274): a, c, t, g, unknown or other
  modified_base (2295)..(2295): a, c, t, g, unknown or other
  modified_base (2337)..(2337): a, c, t, g, unknown or other
  modified_base (2664)..(2664): a, c, t, g, unknown or other
  modified_base (2725)..(2727): a, c, t, g, unknown or other
  modified_base (2775)..(2775): a, c, t, g, unknown or other
  modified_base (3063)..(3063): a, c, t, g, unknown or other
  modified_base (3684)..(3684): a, c, t, g, unknown or other
  modified_base (3717)..(3717): a, c, t, g, unknown or other
  modified_base (3726)..(3726): a, c, t, g, unknown or other
  modified_base (3784)..(3784): a, c, t, g, unknown or other
  modified_base (3891)..(3891): a, c, t, g, unknown or other
  modified_base (3999)..(3999): a, c, t, g, unknown or other
  modified_base (4183)..(4183): a, c, t, g, unknown or other
  modified_base (4188)..(4188): a, c, t, g, unknown or other
  modified_base (4197)..(4197): a, c, t, g, unknown or other
  modified_base (4267)..(4267): a, c, t, g, unknown or other
  modified_base (4305)..(4305): a, c, t, g, unknown or other
  modified_base (4446)..(4446): a, c, t, g, unknown or other
  modified_base (4453)..(4453): a, c, t, g, unknown or other
  modified_base (4455)..(4455): a, c, t, g, unknown or other
  modified_base (4457)..(4458): a, c, t, g, unknown or other
  modified_base (4460)..(4461): a, c, t, g, unknown or other
  modified_base (4545)..(4545): a, c, t, g, unknown or other
  modified_base (4609)..(4609): a, c, t, g, unknown or other
  modified_base (4620)..(4624): a, c, t, g, unknown or other
  modified_base (4626)..(4626): a, c, t, g, unknown or other
  modified_base (5376)..(5376): a, c, t, g, unknown or other
  modified_base (5391)..(5391): a, c, t, g, unknown or other
  modified_base (5400)..(5400): a, c, t, g, unknown or other
  modified_base (5421)..(5421): a, c, t, g, unknown or other
  modified_base (5619)..(5619): a, c, t, g, unknown or other
  modified_base (5621)..(5623): a, c, t, g, unknown or other
  modified_base (5625)..(5626): a, c, t, g, unknown or other
  modified_base (5628)..(5628): a, c, t, g, unknown or other
  modified_base (5670)..(5673): a, c, t, g, unknown or other
  modified_base (6015)..(6015): a, c, t, g, unknown or other
  modified_base (6117)..(6117): a, c, t, g, unknown or other
  modified_base (6132)..(6132): a, c, t, g, unknown or other
  modified_base (6141)..(6141): a, c, t, g, unknown or other
  modified_base (6171)..(6171): a, c, t, g, unknown or other
  modified_base (6189)..(6189): a, c, t, g, unknown or other
  modified_base (6201)..(6201): a, c, t, g, unknown or other
  modified_base (6204)..(6204): a, c, t, g, unknown or other
  modified_base (6207)..(6207): a, c, t, g, unknown or other
  modified_base (6216)..(6216): a, c, t, g, unknown or other
  modified_base (6228)..(6228): a, c, t, g, unknown or other
  modified_base (6243)..(6243): a, c, t, g, unknown or other
  modified_base (6258)..(6258): a, c, t, g, unknown or other
  modified_base (6261)..(6261): a, c, t, g, unknown or other
  modified_base (6273)..(6273): a, c, t, g, unknown or other
  modified_base (6291)..(6291): a, c, t, g, unknown or other
  modified_base (6324)..(6324): a, c, t, g, unknown or other
  modified_base (6333)..(6333): a, c, t, g, unknown or other
  modified_base (6337)..(6337): a, c, t, g, unknown or other
  modified_base (6345)..(6345): a, c, t, g, unknown or other
  modified_base (6381)..(6381): a, c, t, g, unknown or other
  modified_base (6408)..(6408): a, c, t, g, unknown or other
  modified_base (6420)..(6420): a, c, t, g, unknown or other
  modified_base (6423)..(6423): a, c, t, g, unknown or other
  modified_base (6426)..(6426): a, c, t, g, unknown or other
  modified_base (6429)..(6429): a, c, t, g, unknown or other
  modified_base (6462)..(6462): a, c, t, g, unknown or other
  modified_base (6471)..(6471): a, c, t, g, unknown or other
  modified_base (6480)..(6480): a, c, t, g, unknown or other
  modified_base (6483)..(6483): a, c, t, g, unknown or other
  modified_base (6486)..(6486): a, c, t, g, unknown or other
  modified_base (6498)..(6498): a, c, t, g, unknown or other
  modified_base (6504)..(6504): a, c, t, g, unknown or other
  modified_base (6508)..(6508): a, c, t, g, unknown or other
  modified_base (6589)..(6591): a, c, t, g, unknown or other
  modified_base (6834)..(6834): a, c, t, g, unknown or other
  modified_base (6985)..(6990): a, c, t, g, unknown or other
nnnnnnnnnnnnnnnnnnnnnnnnnnnnnnnnnnnnnnnnnnnnnnnnnnnnnnnnnttggcagacaaatccaagaaatggaagcagttacaatcaaagcgttttgccgaaaagagaaagttcggatttgtggattcacagaaggaagaaatgccaccaaancatgttcgcaagattattcgagaccatggcgacatgacttcgcgcaaataccgccatgacaagcgtgtatatcttggcgctttgaaatatatgccgcatgctgttataaagctactcgagaacatgccaatgccatgggaacaaattcgtgatgtcaaagttctttaccacatcactggagcaatcactttcgtcaatgaagttccgcgtgttattgagccagttttcattgcgcaatggggaaccatgtggattatgatgcgtcgagagaagcgcgatcgacgccacttttaacgaatgcgctttccaccatttgatgacgaagaaccacctttggactatgcggacaacattctggatgtggagccantnnanccaattcagatggaactgacngaagangangaaggtctngtgaangactggttctatgaccacaagcntttggcnaaaacanggtttgtcaatggcgaatcataccgaagttgggcgttctccattccaatcatgtctactctctatcgcctcgcaaaccaactactcaccgacctgctggatgagaattatttctacctgtttgacattaaatcattctttacggccaaggcattgaatgttgccatcccaggaggaccaaaatttgaaccattgatccgagatttgaatnangatgaggattggaatgagttcaatgacatcaacaaagtgatcatccgttcaccaattcgcacggaatatcgcatcgctttcccattcatgtacaacaatttgatcagngcgttgccagtgactgtcaactggtatcacaccccatcggtggtctacatcaaaacagaggattatgatttgcccgcattctatttcgacccactgatcaatccaatcgcgcagagaaacacggagcggatgcccgaaccattgccgnnnnnngatgatgaagaagagtttaaattgccaggcgatctccaaccaatgtttggcgactttccgctttacacagaaaatactgcaaatggaatggctcttttatgggcaccaagaccattcaacattcgttcgggacgaacaagaaggattattgatgttccattggtgaaaagttggtacaaagaacattgtccagccggcatgcctgtcaaagtccgcgtctcttatcaaaaantattgaaaatatttgttctgaacgcactcaaacatcgnccaccgaagccacagaagaagnggtatttgttccgctcattcaaatcaaccaagttcttccaatcaacaacacttgattgggttgaggcnggtttgcaagtgctncgccaaggttacaacatgcttaatttgctgatccatcgcaagaatttgaattatnnncatcttgattacaacttcaatcttaagccggtcaaaacactgacaaccaaagaacggaagaaatcacgattcggaaatgcattccatttgtgtcgngagatnctgngacttaccaaactggttgtggatgcacatgtgcaatatcggctgaacaatgtggatgcttaccaattatctgatggtcttcaatacattttngcccatgtnggtcanctgactggaatgtatcgctacaaatacaaactgatgcgacaagttcgaatgtgcaaggatttgaagcatctcatctactatcgattcaacacnggaccagttgcnaaagggccnggntgtggaatttgggcacccggntggcgngtntggctnttcttncttcgaggnatnacgccacttttggagcgatggctcggaaacttgctttctcgtcaattcgaaggtcgacattccaagggtgtggcgaaaaccgtgacaaancaacgcgttgagtcccactttgatcttgaattgagggcngcagtcatgcacgacattttggatatgatgccggaaggaatcaagcagaataaagcgcgtgtcattctccagcatttgagtgaagcatggcgttgttggaaagccaatattccatggaaagttcctggcctgccaacnccagttgaaaatatgattcttcgttatgtgaaagcaaaagctgattggtggacaaattcggcacattacaaccgtgaacgtgtcaggcgnggngcaacngtggataaaactgtttgcaanaagaatcttggtcgtctcacgcgtctttatttgaaggctgancaagaacgtcaacacaattacctgaaggatggcccttatgtcagtgcagaagaagctgtggctatttatacaacaactgtgcattggctggaatcaaggcgcttttcgcccattccattcccacctctttcctacaaacacgacacaaaattgcttattcttgcattggaacgcctgaaggaagcttattccgtgaagaatcgcctcaaccaaagtcaaagagaggaattggcgttgattgagcaggcttacgacaatccacacgaagcactctcgagaatcaagcgacacatgctgacaatgcgctcattcaaggaagttggcatngagtttatggatctttacagcaacctcattcctgtgtacgacattgaaccgcttgaaaagnnnactgatgcttatttggaccaatatgtttggtatgaggcggataaaagncgtttattcccatcttgggtgaagccagcagacaccgaacctgcgccacttttggtctacaaatggtgtcaaggaattaacaatttgcaagatgtgtgggataccagcgaaggcgaatgcgacgttcttttggaagcaaaattggagaagatgtatgaaaagatggacttgactctgctgaacagattacttcgtcttattgtggatcacaacattgccgactatatgactgccaagaacaacgttacaattaattacaaggacatgaaccacacaaattcatttganattattcgcggtctccaattcgcatcattcattgtccaatactatggtttggttcttgatcttttgattcttggtcttcgtcgagcaagtgaaattgcaggaccaccacaatgtcccaatgaattcttggcatttgaagacattcaaaccgaatcctgccacccaatccgtttgtattgccgatatattgacaaagtgtggatgttcttccgcttcaattccgatgagaccagagatttgattcaacgctatttgtctgaacatcccgacccgaacaatgagaatatcgtcggctacaacaacaaaaaatgttggcccagagatgccagaatgcgtctgatgaagcacgatgtgaatttgggcagagctgtcttttgggatatcaagaatcgtcttcctcgttccatcagcaccatcgaatgggaaatgtcatttgtttcggtttacagcaaggacaatcccaatttgttgtttgacatgtccggctttgaatgccgcattttgcccaagtgcaggatggcaaccgatgacacggccaatcgcgatggaatttggaatcttcaaaatgaagtcaccaaagagaggacggcgcaatgctttctgaaagtagatgccgaatcnatggagaaattccacaatcgtgttcgccaaatnctcatgtcntccggatcaaccacctttacaaaaattgtgaacaaatggaatactgcactcattggantgatgacctatttccgagaagcagttgtgaacacgcaagaactcctggatcttctagtcaaatgcgaaaacaaaatacaaacaagaatcaaaattggtctgaattcnaaaatgccggctcgtttcccgccggtcgtcttttacactccaaaggaaattggtggacttggcatgctttcaatgggtcatgtgcttatcccacaatctgatttacgntggatgcgccaaacagatgctggtggaatcactcatttccgaagtggaatgacgcatgatgaagatcaaatcattcccaatctttatcgttatatccagccatgggaagcagaatttgttgattcccaacgtgtctgggccgaatacgcactcaaaaggcaggaagcaaatgcgcagaacagangattnactttggangacttggatgatagctgggatcgcggaattcctcggatcaacacactcttccaaaaggatcgaaacacantggcctatgacaaaggatggcgagtgcgcactgaattnaaggcctaccaaattctcaagcaaaatccattctggtggacccatcaaaggcacgatggaaaattgtggaatttgaacaactatcgaaccgatatgatccaagcacttggaggtgtggaaggaattcttgagcacacgctntttagangnanntnntttcccacatgggaaggtctattctgggagcgtgcctccggtttcgaagaatcaatgaaattcaagaagttgacaaatgcacancgctccggtttgaatcaaattcccaatcgtcgttttacactttggtggtcgccaacaattaacngagccaatgtnnnnntnggtttccaagtccaacttgatctcactggaatttttatgcacggaaagctgccaactttgaaaatttctttaattcagatcttccgtgctcacttgtggcagaaaatccacgaatcggttgtcatggatctttgtcaagtctttgatcttgaattggatgcgctcgagatccagacagtccagaaagagacaatccatcctcgtaaatcatacaaaatgaacagttcctgcgctgacatccttcttttcgcacaatacaaatggcacatctcaagaccatctttgctggccgacaccaaggatgtgatggacaataccacaacgcaaaagttctggctggatgtgcagcttcgatggggtgactatgattcgcatgacattgagcgctattcacgtgccaaattcttggattatacaaccgacaacatgtccatctacccatcaccaaacggaatactcattgcaattgatttggcctacaatttatacagcgcctatggcaactggttccccggcatgaaagtgttgatccgtcaagcgatggccaagattatcaaggcaaatcctgcactttatgtgcttcgcgagcgtatacgcaagggtcttcaattgtactcttcggaaccaaccgaaccatacctgacatcgcaaaattatggcgaattgttcagcaatcaaatcatttggtttgttgatgacaccaatgtgtaccgtgttaccattcacaagactttcgaaggaaacttgacnactaaaccaatgaanggagcaatnttcattttcaatccaagaacnggacaactctttttgaaaatcattcacacaagtgtttgggctggacaaaagcgtttgagtcagttggcaaaatggaaaactgccgaagaagtggctgctttgattcgatctttgcctgttgaagaacaaccacgacagatcattgttacacggaaggcaatgcttgacccgcttgaagtccacttgcttgatttcccnannntnntnatcaaaggctccgaattgatgttgccattccaggcaattatnnnnattgagaaatttggtgatctcattttgaaggcaaccgagccacaaatggttttgttcaatttatatgatgactggctaaagacaatctcgagttacaccgcattttcgcgtgtcattctgataatgcgcggaatgcacatcaatcctgacaaaaccaaggtgattctgaagccagaccggacaacaatcactgaaccccatcacatctggcccacactttctgatgaagactggatcaaagttgagctggcattgaaggacatgattctgaatgactacggcaagaagaacaacgtgaatgttggctctctcacccaatccgaagttcgtgatatcattctnggcatggagatcagtgcgccatcgcaacaacgccaacaaatcgccgaaattgagaaacaaaccaaggagcaaagtcaactgacagccacaaccaccaaatcnacaaacaagcacggngatgagatnatctcggcaacaactagcaattatgaaacncaaacattctcgtctcgnacagagtggcgngtncgngcaatctgntcaacaaacttncatttgcgaacgcancacatttacatcaanccngatgatgtcaangacactggctacacatanatcatgcccaagaacattctcaagaaattcatnacaatttcngatntgcgcacncaaattgctggctacatctatggcgtctcgcctccngataatccgcatgtcaaggagattcgntgcattgttctnccnccncantggggaacgcaccaagtcgtgcatttgccgaancaattgccncagcatganttnctnaaagatttggancccctngganggatgcacacacaacccaacgaattatcgcagctatcacctcaagatgttacaatgcattccaaaatcattcatcaaaatnnncaatgggatggcgagaaaaccgtgatcatcacttgcagcttcacacccggctcggtttcactgattgcctaccatcttacaccaagcggattcgaatggggtcgcaacaacacggacaaaggaaacaatccgaagggctacttgccgtcgcattatgagaaagtgcaaatgctgctgtccgaccgctttcttggatatttcatggtcccgtccgccggtgtttggaattacaacttcatggtngttcgccacgatgctaacatgcaatacgatgtgtgtttggctgcgccgaaggaattctaccacgaagaccatagaccgctccacttccacaatttcaatgtattcgaggatccgttgggcgttgcttcagctgacagagaagatgcgtttnnnnnn

SEQ ID NO: 788 - DNA, 1014 bp, Artificial Sequence
  Description of Artificial Sequence: Synthetic polynucleotide
  modified_base (11)..(11): a, c, t, g, unknown or other
  modified_base (123)..(123): a, c, t, g, unknown or other
  modified_base (180)..(180): a, c, t, g, unknown or other
  modified_base (570)..(570): a, c, t, g, unknown or other
  modified_base (702)..(702): a, c, t, g, unknown or other
  modified_base (757)..(1014): a, c, t, g, unknown or other
atgggaaaaanttcgaaggacaaacgtgatatttattaccgattggccaaagaggaaggctggcgagcacgttccgcatttaaactccttcaaattgaccaattattcgggatctttgaagangtatcaagagctgttgatctttgtgccgcgcccggttcatggagtcaggtttgaggngaggaggatgaggaaaggaggaaagcggtgaagatcgtggcggttgatttgcaaccgatgtcaccactgccaggcgtgacacaactgcaaggagacattacagagatgaaaacggcccaggaaataatttcttactttgatggcgaattagcacaacttgtgatttgtgatggggctccgatgagccaattggtgttctcggtagaatttaatattatttgttatctttttaaacaggcattcaacatcacttcgtgcattctatccagagggggcacatttgtgtcaaagatttttcgtgcaaagaatgttgatctcctctacgcacagatgaagcaatttttcaaagaggtggtttgttgcaagccaaaaagtagccggcaatccagntgtgaagctttcattgtttgcaaaaattatacgccaccggatggttttgagcccactttgaaaaatcccttgttggcgccaaattacagtttgttgtttaagaaggattgtcatgaaaaacttattttcatnggtgatcttgctggcttcgattccgatcgcacctatccactggaactgaatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 789 - DNA, 978 bp, Artificial Sequence
  Description of Artificial Sequence: Synthetic polynucleotide
  modified_base (1)..(72): a, c, t, g, unknown or other
  modified_base (160)..(168): a, c, t, g, unknown or other
  modified_base (300)..(300): a, c, t, g, unknown or other
  modified_base (862)..(864): a, c, t, g, unknown or other
  modified_base (970)..(978): a, c, t, g, unknown or other
nnnnnnnnnnnnnnnnnnnnnnnnnnnnnnnnnnnnnnnnnnnnnnnnnnnnnnnnnnnnnnnnnnnnnnnntttacatttacataacaattaataatttttgctttaaatacagacaaaaccatcattgtgtggtctcttgatgaaagtggctcggtgnnnnnnnnncttactggcaaaccgatcaaatctctgcacgggcatgggcactttgtttcggatgtggtcatgtcatcggacggtcaatatgcgctttccggctcttgggacaaaacactgcgtctttgggatttgaacacnggccaatcgactcgccagtttgtctcccatacgcaggatgttctgtctgtggctttctcagctgacaaccgacagattgtttctggcgcacgcgacaagaagatcaaactgtggaacactcttgcccagtgcaaacacaccattgtggatgagtgccacactgattgggtttcaactgtgcgcttctcgccatcaaatgcgaacccggtcatcgtttctgctggatgggacaagatcgtcaaagtttggaatttgggaacatgccgtctcaagaccaaccacatcggacacaacggctatatcaattcggtcactgtctcacccgatggttcgctttgtgcttccggtggcaaggatggttctgccatgctttgggacttgaacgaaggaaagcatctctacacgctgggcggcaacgatgtgatcaattcgcttgccttctcccctaaccgctactggctttgtgccgccgttggaccagttgtgaagatctgggatctggaggacaagaccatcgtggacgagctgaagctggacattgcaagcaccaacctgaagaagnnntcgccaccacagtgcacttcgcttgcctggtcctcggatggacagacattgtttgttggctacacggacaatatcatccgcgtgtggcgagtttcggctgcagccnnnnnnnnn

SEQ ID NO: 790 - DNA, 402 bp, Artificial Sequence
  Description of Artificial Sequence: Synthetic polynucleotide
  modified_base (1)..(21): a, c, t, g, unknown or other
  modified_base (109)..(109): a, c, t, g, unknown or other
  modified_base (111)..(111): a, c, t, g, unknown or other
  modified_base (199)..(285): a, c, t, g, unknown or other
  modified_base (394)..(402): a, c, t, g, unknown or other
nnnnnnnnnnnnnnnnnnnnnaaatcccacattcaggccttcgtgcaacactactacagcaagtttgatgtgcccgatccgcaggcccgttgcactgggctcaccgatntntacgatccggagcactcgttcatgaccttcgaaggcaaccaggtccagggccgcctggcaatcctcgagaagtttgcggtgagtgggnnnnnnnnnnnnnnnnnnnnnnnnnnnnnnnnnnnnnnnnnnnnnnnnnnnnnnnnnnnnnnnnnnnnnnnnnnnnnnnnnnnnnnncagacggacgacgacccggtcaactcgttcaaccactgcttcattctgcggcccaacggcaacggctccttctacatttccaacgagattttccgtctggttctgcacnnnnnnnnn

SEQ ID NO: 791 - DNA, 333 bp, Artificial Sequence
  Description of Artificial Sequence: Synthetic polynucleotide
  modified_base (1)..(24): a, c, t, g, unknown or other
  modified_base (44)..(45): a, c, t, g, unknown or other
  modified_base (47)..(51): a, c, t, g, unknown or other
  modified_base (54)..(55): a, c, t, g, unknown or other
  modified_base (58)..(60): a, c, t, g, unknown or other
  modified_base (63)..(63): a, c, t, g, unknown or other
  modified_base (65)..(65): a, c, t, g, unknown or other
  modified_base (67)..(72): a, c, t, g, unknown or other
  modified_base (315)..(315): a, c, t, g, unknown or other
  modified_base (330)..(333): a, c, t, g, unknown or other
nnnnnnnnnnnnnnnnnnnnnnnngctttgaggttttttgcttnnannnnncannttnnnaananannnnnncaggtcaagaagtggaatgccgtcgccctttgggcctgggacatcgtggtcgacacttgcgccatttgccgcaaccacatcatggacttgtgcattgagtgccaagccaatcaggcatcgtccaccaacgaggagtgcaccgtggcctggggcgtctgcaaccacgctttccacttccattgcatctcgcgctggctgcgcactcgtcaggtctgcccattggacaaccgcgactgggagttncagaagtacgggcannnn

SEQ ID NO: 792 - DNA, 576 bp, Artificial Sequence
  Description of Artificial Sequence: Synthetic polynucleotide
  modified_base (1)..(63): a, c, t, g, unknown or other
  modified_base (120)..(121): a, c, t, g, unknown or other
  modified_base (125)..(131): a, c, t, g, unknown or other
  modified_base (133)..(133): a, c, t, g, unknown or other
  modified_base (135)..(137): a, c, t, g, unknown or other
  modified_base (139)..(140): a, c, t, g, unknown or other
  modified_base (142)..(143): a, c, t, g, unknown or other
  modified_base (145)..(149): a, c, t, g, unknown or other
  modified_base (153)..(154): a, c, t, g, unknown or other
  modified_base (156)..(156): a, c, t, g, unknown or other
  modified_base (158)..(158): a, c, t, g, unknown or other
  modified_base (164)..(164): a, c, t, g, unknown or other
  modified_base (174)..(174): a, c, t, g, unknown or other
  modified_base (186)..(186): a, c, t, g, unknown or other
  modified_base (225)..(225): a, c, t, g, unknown or other
  modified_base (268)..(268): a, c, t, g, unknown or other
  modified_base (270)..(270): a, c, t, g, unknown or other
  modified_base (321)..(321): a, c, t, g, unknown or other
  modified_base (330)..(330): a, c, t, g, unknown or other
  modified_base (349)..(349): a, c, t, g, unknown or other
  modified_base (351)..(351): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (453)..(453): a, c, t, g, unknown or other
  modified_base (574)..(576): a, c, t, g, unknown or other
nnnnnnnnnnnnnnnnnnnnnnnnnnnnnnnnnnnnnnnnnnnnnnnnnnnnnnnnnnnnnnncaataccaatactatttggacaggctgacgccctacactgcaattcgatgggtaaanncaannnnnnnantnnntnnanntnnnnnaaanntnantatttnccagggcttntacattgtcacntacgcgttgttcatctactacctgaatctcttcttggcntttctgacacccaaaattgacccggccatggagtttgaagaantngacgaaggcccggtgctgccaaagagcaacagcgaagagtttcgcccgttnatgcgccgnctgcccgaattcaaatttngnctctccacaatgaaggccacnctgatngcntttgggtgcacattcttcgaggtgttcgacattcccgtcttttggcccatcctcgtcatgtacttcatttgnctcacctgtctgacaatgaagcgccaaataatgcacatgatccggtatcgttacattccattcacgacgggcaaaccgcgtccacagggcaaggaggacagcgggaaagtggttttgggannn

SEQ ID NO: 793 - DNA, 1005 bp, Artificial Sequence
  Description of Artificial Sequence: Synthetic polynucleotide
  modified_base (1)..(36): a, c, t, g, unknown or other
  modified_base (255)..(255): a, c, t, g, unknown or other
  modified_base (459)..(459): a, c, t, g, unknown or other
  modified_base (826)..(1005): a, c, t, g, unknown or other
nnnnnnnnnnnnnnnnnnnnnnnnnnnnnnnnnnnngttgaaaagtaccgaccaaagacacttgatgatgttgtaggaaatcctgaaacaatagatcgtctgaaggcaattgttaaaaccggcaacataccaaatctgatcatttcgggacctccaggttgcggcaaaaccacgagtgtctgggcaatggcgagagacatgcttggagacaaagtcaaggatgcgtgccttgagttgaatgctagcgacgaaggnggcattgatgttgtccgcgatcgcataaaacgctttgcatcaacaaaagtgacattgggtggaaatgctcagaaaattgtgattttggatgaagccgacagcatgactgaaggagcacaacaagcattgcgtaggatcatggaggttttcagttcaaccactcgctttgcctttgcttgcaatcaatcggacaagataataaanccactccaatctcgctgtgccatcatcaaatacaccaaactaagcgatgaacaattgctcgaaaggatgcttcacatatgcaaggaagaaaacttaaaattcacggagcagggaatgaaggcaattctttacactgcacagggcgatatgagacaggcactcaacaacatgcaatgcatatttgccagttatggcaaaatcagcaaggacttcgtctacaaagtttgcgatgagcctcatcccaacaagataaacgaaatattcgagcactgcactctcggacaaacaaatgaggcatccgatgtgattgaggagttgtacagcttgggctattctgtggatgatttggtcggcattatgttcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 794 - DNA, 1065 bp, Artificial Sequence
  Description of Artificial Sequence: Synthetic polynucleotide
  modified_base (40)..(48): a, c, t, g, unknown or other
  modified_base (300)..(300): a, c, t, g, unknown or other
  modified_base (399)..(399): a, c, t, g, unknown or other
  modified_base (700)..(819): a, c, t, g, unknown or other
  modified_base (925)..(927): a, c, t, g, unknown or other
  modified_base (1033)..(1065): a, c, t, g, unknown or other
atggcactttgggtggacaaataccgaccgcatgacttannnnnnnnntccaagttggactaccatcaaatccaagccgagaagttagatctggttagcaatggaaacttcccgcatctaatgttctgtggtccaaatggtgccggcaaacgcactcgaattcattgtctgctgaaagaaatttacggccgaggtgttgagaatgtgcgtgtggaggaacaccaattccaaactcaaagcggcaagaagttacaaatcaatgttctgaacagcaactatcacatcgaattgacaccgtgngatgttggcatttacgacagagtggtagttcaagaaataatcaagggaatggcggaggtccagcagctaatcaagacgacccagaaaacatacaaattngttgtgctgttagaagccgaaaatctgaccaaagaagcacaacattcattgcgaaggacaatggagaaatatgcggctacttgcaaaatcatactatgctgtggatcgtccagccgcattattgagccacttcgcagtcgttgcatgattattcgtgtacctgcgcccaaaaaattccaagtgcttgatgttctcaacattgttgccaacaaagaacgcattgatgcatccgaggattggctaatcagtttggcgaagaacgcaaatgggaacatgcgtcgcgcactttgtcttttcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatggaagtacgcaaccgtttttacgagctgctttgtcgctgcattccagcttgtgtcattttcaagggtctggtaaaagagctagccaaacaatgccctccannnctgcttcagccaatcgtagaagctgcagccaaatttgaacacagcagcaatctgggcagcaaggttatctatcatttggaagcttttgcgtcaaccgtcatggaannnnnnnnnnnnnnnnnnnnnnnnnnnnnnnnn

SEQ ID NO: 795 - DNA, 1005 bp, Artificial Sequence
  Description of Artificial Sequence: Synthetic polynucleotide
  modified_base (1)..(108): a, c, t, g, unknown or other
  modified_base (318)..(318): a, c, t, g, unknown or other
  modified_base (334)..(336): a, c, t, g, unknown or other
  modified_base (454)..(456): a, c, t, g, unknown or other
  modified_base (556)..(1005): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtctatttccgatataataaacaattcacagttgccaaatctcctgctttatggtccgccagggacaggaaagacttcggctgcggttgctctttgccgcaacttttccactcctcaaatgtacaaggatcgggtgcttgaaatgaatgcctcggatgagcgcggcattgacattgttcgcaatcgggtattatttaatactaaattnaccttgaagaacagcnnnaaggatgcgttggtgccgctgaaaattgtcattttggatgaggccgacgcaatgactggtgcggcacaatccgctcttcgaagaaccatggagaacgagacacaaacaacgcgcttcnnnctcatctgcaactacatcacgcgcatcattgagccgctcacttcgcgttgtgcaaaattccggttcaaaccactctcggcggaaacacagaaacaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 796 - DNA, 576 bp, Artificial Sequence
  Description of Artificial Sequence: Synthetic polynucleotide
  modified_base (1)..(381): a, c, t, g, unknown or other
  modified_base (411)..(411): a, c, t, g, unknown or other
  modified_base (474)..(474): a, c, t, g, unknown or other
  modified_base (549)..(549): a, c, t, g, unknown or other
  modified_base (574)..(576): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtgaccaaggagtgctacatgcttggntcatttggacccaaacgcgacctctacgaatatgaaacacctccggaggaagcaccttcaganatgctgagccgtggcaagtaccgagttcgttccctgatttccgacgacgacaaaaaccgctggctggaatggtcntggacgattgaaattggaaaggacnnn

SEQ ID NO: 797 - DNA, 2367 bp, Artificial Sequence
  Description of Artificial Sequence: Synthetic polynucleotide
  modified_base (1)..(15): a, c, t, g, unknown or other
  modified_base (144)..(144): a, c, t, g, unknown or other
  modified_base (171)..(171): a, c, t, g, unknown or other
  modified_base (184)..(184): a, c, t, g, unknown or other
  modified_base (198)..(198): a, c, t, g, unknown or other
  modified_base (255)..(255): a, c, t, g, unknown or other
  modified_base (299)..(300): a, c, t, g, unknown or other
  modified_base (391)..(391): a, c, t, g, unknown or other
  modified_base (393)..(396): a, c, t, g, unknown or other
  modified_base (398)..(398): a, c, t, g, unknown or other
  modified_base (400)..(403): a, c, t, g, unknown or other
  modified_base (405)..(405): a, c, t, g, unknown or other
  modified_base (411)..(411): a, c, t, g, unknown or other
  modified_base (504)..(504): a, c, t, g, unknown or other
  modified_base (510)..(510): a, c, t, g, unknown or other
  modified_base (522)..(522): a, c, t, g, unknown or other
  modified_base (537)..(537): a, c, t, g, unknown or other
  modified_base (552)..(552): a, c, t, g, unknown or other
  modified_base (895)..(1029): a, c, t, g, unknown or other
  modified_base (1056)..(1056): a, c, t, g, unknown or other
  modified_base (1104)..(1104): a, c, t, g, unknown or other
  modified_base (1106)..(1106): a, c, t, g, unknown or other
  modified_base (1128)..(1128): a, c, t, g, unknown or other
  modified_base (1135)..(1135): a, c, t, g, unknown or other
  modified_base (1429)..(1429): a, c, t, g, unknown or other
  modified_base (1446)..(1446): a, c, t, g, unknown or other
  modified_base (1572)..(1572): a, c, t, g, unknown or other
  modified_base (1729)..(1734): a, c, t, g, unknown or other
  modified_base (1836)..(1836): a, c, t, g, unknown or other
  modified_base (1839)..(1839): a, c, t, g, unknown or other
  modified_base (1914)..(1914): a, c, t, g, unknown or other
  modified_base (1920)..(1920): a, c, t, g, unknown or other
  modified_base (1962)..(1962): a, c, t, g, unknown or other
  modified_base (1986)..(1986): a, c, t, g, unknown or other
  modified_base (2317)..(2367): a, c, t, g, unknown or other
nnnnnnnnnnnnnnntccccgtacgtgatcaagcgggacgggcgccgagaggagattctgcccgagaagatcacatcacgcgtcaaaaagctctgctacgggctcaacatgaattacataaatccggcgcaaatcacggagaangcggccagtggcatttacaagggagtnacaaccgtggagntggacaatttcgcngcggaagtggccgcctcgatgaccacaatgcacccggactatgcgctgctggctgcncgcattgccatctccaatctgcacaaagagactaataaggtttnntcggaggtgatccacgccctctacagttatgtggaccccgaggacggctgcgcatcgcccatggtcagcgaggacgtgtaccggattgtgnannnnancnnnnanatcctnaactccacaatcatctacgaccgcgacttcgcctacacctacttcggcttcaaaaccctcgaacgctcgtacctgctgaagatcaatggcaangtggtngaacgaccccancaaatgctgatgcgngtggcggtcggcatncacaagcaggacattcaggcggcaatacagacctacaatctgatgtccgagcgctggttcacgcatgcctcgccaacgctgttcaatgcgggcacctgcttcccacagctgtcctcctgctttctgctgccacccatcgaggactccatggagggaatttgcaaggagctgaccgactgcgcactcatctccaaatctgcgggtggtattgggctgagtgtgcacagcgttcgggcgtttgggtccaggattaagacgacaaaaggcatctccaatgggattgtgccaatgctgcgtgtctacaacaacatgtcccgctacgtggaccaaggcggaaataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatggaacgcgtcaaatccgatggncagtggtcgttgatgtgcccgaagaagtgtcccggcctgcagctttgntngggcgaggagttcaacaagctntatgcanagtacgaaagcgaaggccgcttcaaccgccaattgccagcccgcgaagtgtggaagcgcatcatcaccgcccaaacggaaacgggcacgccctacatgctctacaaggacgcgtgcaaccgcaagtccaaccaacagaacctgggcacaatcacctgctccaacctgtgcaccgagatcatcgagttcacttccaaggaggagattgcggtttgcaacttggcgtccattgcgttgccccggtttgtgcgcgatcagaaggggttcgactttgtgaagctgaaggaggtcaccnaggttgtaacacgcaanctgaacaaaatcatcgacgtcaaccgctaccccgtgcccgaagccgaacgctccaacaaacgccatcgtcccattggcattggggttcagggccttgccgacgctttcctgctgatgcgcctcccnttcgtcagcgagcaagcaaaactgctgaaccggcaaatcttcgagaccatctactacggggcactggaggcgtcctgcgagttggccatggtggagggaacctacgagacctaccagggatcgccagttagtcgtggggagcttcaatacgacatgnnnnnngtggcgcccaccgacctctgggactgggccgcgctgaaggcgaaaattgccctgcacggagtgcgcaacagcctgctgcttgccccaatgccgaccgcatcnacngcacaaatcctgggcaacaacgagtccatcgagccgtacaccaccaacatctacagccgacgggtgctttccggngatttncaggttgtaaacccgcacctgatgaaggacatgatcgagctnaacctgtgggacgaccagatgaancagcgcctcatctccgaaggcggctccgtgcagaacatccgcgagctgcccgaccacatccgggaactctacaagaccgtctgggaaattccccaaaaggagctgatgaacatggccgccgaccgggccgccttcattgaccagagccagtcgctgaacctgttcattgcggagccgacctactcgaagttgacgtccatgcacttctacggctggcaattgggcctcaaaacgggcatgtactacttgcgcacccgtccggcggtggatgccgtcaagttcacggtgaacaagcaggcattgcgcgaagcgagaccaacaaactggccannnnnnnnnnnnnnnnnnnnnnnnnnnnnnnnnnnnnnnnnnnnnnnnnnn

SEQ ID NO: 798 - DNA, 939 bp, Artificial Sequence
  Description of Artificial Sequence: Synthetic polynucleotide
  modified_base (147)..(147): a, c, t, g, unknown or other
  modified_base (709)..(711): a, c, t, g, unknown or other
  modified_base (937)..(939): a, c, t, g, unknown or other
atgggcagggaagacagaaccacctggaaagcgaattatttcacccgtatcattacgctcttcgatgaatatccgaagtgtttccttgttggcgttgacaatgtgggatcaaagcaaatgcaggaaatccgtcaagcaatgcgagancatggcgaaattctgatggggaagaacaccatgattcgaaaggcaatccgaggccatttgcaaaagaatcctcagcttgaaaagctcttgccatacattgttggaaatgttggctttgtctttaccagcgaggacttggctgagattcgcaagaagttgctggagaacaaacgaggtgctcctgcgaaggccggcgccattgctccatgtgacgtgaagttgccaccgcagaatacgggaatgggtcctgagaagacttccttcttccaagcactccaaattccgacaaagatttcgcgcgggaccatcgagatcctcaacgaggtgcacatcatcaagattggcgagaaagtgggcgcttcggaggccgcgttgctcaacatgttgaacatccaaccattctcatatggtcttgctgtgcaacaggtctacgatggcggtgctgtctattcaccggatgtgttggatgtcaccacagacgatcttcgcgctcgcttcatgcaaggcgtttgcaatgtggctgccgtctcactcgagattggctatccaaccaaagcatccnnngcccatctcattgccaacgcattcaaacgcttgctggctgttgctgccgagaccgaggtcaccttcaagcaggccgaaaaggtcaaagaataccttgccgatccgtccaagttcgccgctgccgcaccagccgcagccgaggcgaaagcagaagcagcagctgcgccaaagaaggaggaagaaaaggaagaatctgacgaggatatgggcttcggattgtttgacnnn

SEQ ID NO: 799 - DNA, 204 bp, Artificial Sequence
  Description of Artificial Sequence: Synthetic polynucleotide
  modified_base (99)..(99): a, c, t, g, unknown or other
  modified_base (112)..(112): a, c, t, g, unknown or other
  modified_base (165)..(165): a, c, t, g, unknown or other
  modified_base (192)..(192): a, c, t, g, unknown or other
  modified_base (201)..(204): a, c, t, g, unknown or other
atgattattccagttcgatgcttcacgtgtggcaaagtgataggcaacaaatgggacgcatatctgcagcttctacagaagggaaacacggaaggagangcaatggaccagntgaatttgcgccgttactgttgccgccgcatgttgctctcccacgtggacttngtggagaagttgctcaactacaacccnatcgagaannnn

SEQ ID NO: 800 - DNA, 369 bp, Artificial Sequence
  Description of Artificial Sequence: Synthetic polynucleotide
  modified_base (141)..(141): a, c, t, g, unknown or other
  modified_base (310)..(369): a, c, t, g, unknown or other
atgaatgccccggaacgtttcaaagcttttctgctggacgatgagaagaagatcgagatccaaaaggacatgaaagtcccaaacgcggccgtcttcacgttcaacaaggaggaccacacgctgggcaacttgctgaagcancaattgctgaaggacccgcacgtgctgttcgcgggctaccgaaatccgcacccgctggagcaccggatcctgctgcgtgtccagaccgactcgaacacaaccccggccgaggccctcgacagcgccatcaccgacctgatcgcggagctctcactgcttgaggagcgannnnnnnnnnnnnnnnnnnnnnnnnnnnnnnnnnnnnnnnnnnnnnnnnnnnnnnnnnnn

SEQ ID NO: 801 - DNA, 636 bp, Artificial Sequence
  Description of Artificial Sequence: Synthetic polynucleotide
  modified_base (1)..(57): a, c, t, g, unknown or other
  modified_base (211)..(212): a, c, t, g, unknown or other
  modified_base (243)..(243): a, c, t, g, unknown or other
  modified_base (246)..(246): a, c, t, g, unknown or other
  modified_base (249)..(249): a, c, t, g, unknown or other
  modified_base (252)..(252): a, c, t, g, unknown or other
  modified_base (255)..(255): a, c, t, g, unknown or other
  modified_base (264)..(264): a, c, t, g, unknown or other
  modified_base (273)..(273): a, c, t, g, unknown or other
  modified_base (288)..(288): a, c, t, g, unknown or other
  modified_base (291)..(291): a, c, t, g, unknown or other
  modified_base (294)..(294): a, c, t, g, unknown or other
  modified_base (461)..(461): a, c, t, g, unknown or other
  modified_base (477)..(477): a, c, t, g, unknown or other
  modified_base (492)..(492): a, c, t, g, unknown or other
  modified_base (628)..(636): a, c, t, g, unknown or other
nnnnnnnnnnnnnnnnnnnnnnnnnnnnnnnnnnnnnnnnnnnnnnnnnnnnnnnnncagatgtgccacgaccgcggctacctggtcacccaggacgagttggaccaaacactggaccagttcaagcaaacgttcggcgaccggcccagtgagaagcgcccgggacgcggggacttgaccattctggtggcgcacaacgacgatccgaccnnccaaatgtacgtgttcttcccggacgacccnaanatnggnatnaagaccatnaagcaaatntgccagcaaatgcangancanaacatcacgcgggccattcttgttgttcaggtcggcatgacgccctcatccaagcaggcaatcactgacatggcgcccaagtacacgctggaatacttcctggaagccgaactgatggtgaacatcacggagcacgagttggtgcccgaacatgtggtgatgaccgncgaggagaaggccganctgctggccaaacanaaactgcgtgagaaccagctgccgcgcatccaagtcagtgacccggtggcgcgctacttcgggctccgtcgtggccaagtggtgaagataatccgtccgtccgagaccgccggccgttacatcacctaccggctcnnnnnnnnn

SEQ ID NO: 802 - DNA, 414 bp, Artificial Sequence
  Description of Artificial Sequence: Synthetic polynucleotide
  modified_base (1)..(219): a, c, t, g, unknown or other
  modified_base (256)..(258): a, c, t, g, unknown or other
  modified_base (412)..(414): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctcggcacccgcgctcttcaaatcgccatgggcnnncccgtgatggtggagaccgagggcgagactgatccgctggagattgcgcgcaaggaactcaaggatcagaagatcccgatcatcattcgccgctatctgcccgacggatcgttcgaggactggggcgtcgatgagttgaccatcacggattggnnn

SEQ ID NO: 803 - DNA, 447 bp, Artificial Sequence
  Description of Artificial Sequence: Synthetic polynucleotide
  modified_base (355)..(447): a, c, t, g, unknown or other
atgacgaacatttattttgaagatttgttcacggtcaagaatgttgatccggatggtaaaaaattcgatcgagttagtcgcctcttttgtgacagcgagtccttcaaaatggatctgattttggacgtcaacacacagatgtacatgcttggcattaacgacaaattccgtttgatgctttgttcctccattcgagacgacgggctcgcggacgaaggagaatatgacaaatcggttgaattgccacgcgtccggatgttcgagtacgtgatgtacgggaaaatctatcgaattgagggagacgaaggcaacaccgagacaagccgacttaccgcttttgcatcttttgggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 804 - DNA, 624 bp, Artificial Sequence
  Description of Artificial Sequence: Synthetic polynucleotide
  modified_base (1)..(24): a, c, t, g, unknown or other
  modified_base (76)..(76): a, c, t, g, unknown or other
  modified_base (78)..(81): a, c, t, g, unknown or other
  modified_base (90)..(90): a, c, t, g, unknown or other
  modified_base (96)..(97): a, c, t, g, unknown or other
  modified_base (111)..(111): a, c, t, g, unknown or other
  modified_base (154)..(156): a, c, t, g, unknown or other
  modified_base (180)..(180): a, c, t, g, unknown or other
  modified_base (201)..(201): a, c, t, g, unknown or other
  modified_base (231)..(231): a, c, t, g, unknown or other
  modified_base (280)..(280): a, c, t, g, unknown or other
  modified_base (565)..(624): a, c, t, g, unknown or other
nnnnnnnnnnnnnnnnnnnnnnnnttaccaaatgcgcacttccacaagcattggcagcgccgcatcaagacctggntnnnncaacccgcncgcaannttcgtcgccgccangcgcgcattgccaaggccgctcgggttgcaccgcgccccgtcnnnaacaagcttcgtcccatcgtgcantgccccagcattcgctacaangccaaggttcgactgggccgagggttcacnctggaggagttgaaagccgccggcctgaccaaatacctggccaagtcgntgggcattgcggtcgactatcgccgcgtcaatcgttccgtggaatcaatcgagagaaacgcaaagcgcctcaaagagtaccgctcacggctgatcatcttcccgaagaaattgagcaagcccaagaagggagacagcagtccagaagagctgaagatggccgcccaagtcaaaggccccgtgatgccaatccgcatccagcgtcgccgcgagaaggcccagcccgtgaccgatgagctcaagaagttctcggtgtactgccacctgcgccgtgtgcgtgccgacnnnnnnnnnnnnnnnnnnnnnnnnnnnnnnnnnnnnnnnnnnnnnnnnnnnnnnnnnnnn

SEQ ID NO: 805 - DNA, 489 bp, Artificial Sequence
  Description of Artificial Sequence: Synthetic polynucleotide
  modified_base (85)..(177): a, c, t, g, unknown or other
  modified_base (270)..(270): a, c, t, g, unknown or other
  modified_base (409)..(489): a, c, t, g, unknown or other
atgcggattgaaaagtgctggttttgctcatcaaacatatacccgggccatggcatccagtttgtgcgcaacgatggcacggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacaggaacttgtcaatgatgccacccaggcaatggaagtgcgccggaatgtgccgaccaagtacgagcgtggactttggaaagaagcatgngatgccatgaagcaaatccatgagatccggcatcgtcgttacgggcaattgatcaagaacaagctgaagcccgggcaacagattcgcaagcagggcatgatcaagaaggccaagacaaagatgcacatgatcaggtcgnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 806 - DNA, 213 bp, Artificial Sequence
  Description of Artificial Sequence: Synthetic polynucleotide
  modified_base (211)..(213): a, c, t, g, unknown or other
atgcctcgccaaatcacggacatcaaggagttcctgctgacagccaggcgcaaggacgcaaagtccgtgaagatcaagaagaaccgcgagaacaccaaattcaaggtccgttgcagccgtttcctgtacacactggtggttgaggacacagagaaggccgagaagctgaagcagtcgttgccgcccggtcttcaagtcaaggaattgaagnnn

SEQ ID NO: 807 - DNA, 156 bp, Artificial Sequence
  Description of Artificial Sequence: Synthetic polynucleotide
  modified_base (78)..(78): a, c, t, g, unknown or other
  modified_base (154)..(156): a, c, t, g, unknown or other
atggctgcgcacaaaacgttcatcatcaagcgcaagctggccaaggccgccaagcagaatcgtccactgcctcactgngtccgcatgaagaccggcaacaagattcgctacaacgcaaagcgtcgccactggcgcaggaccaagctgaagctcnnn

SEQ ID NO: 808 - DNA, 939 bp, Artificial Sequence
  Description of Artificial Sequence: Synthetic polynucleotide
  modified_base (1)..(54): a, c, t, g, unknown or other
  modified_base (540)..(540): a, c, t, g, unknown or other
  modified_base (546)..(546): a, c, t, g, unknown or other
  modified_base (594)..(594): a, c, t, g, unknown or other
  modified_base (598)..(598): a, c, t, g, unknown or other
  modified_base (652)..(652): a, c, t, g, unknown or other
  modified_base (654)..(654): a, c, t, g, unknown or other
  modified_base (657)..(659): a, c, t, g, unknown or other
  modified_base (661)..(661): a, c, t, g, unknown or other
  modified_base (664)..(664): a, c, t, g, unknown or other
  modified_base (919)..(939): a, c, t, g, unknown or other
nnnnnnnnnnnnnnnnnnnnnnnnnnnnnnnnnnnnnnnnnnnnnnnnnnnnnngctgcgccacaggactcgaatcaagtggatacggctgagacggtctacattagctcattggcattgctgaaaatgttgaaacatggacgtgctggtgtgccaatggaggttatgggcctaatgttgggagaatttgtcgatgactatacggtgaatgtaattgatgtgtttgcaatgccgcagtctggaacgggagtttctgtggaagcagtggatccggtattccaagccaagatgattgacatgctcaaacaaactggtcgcccagaaatggttgttggttggtatcactcgcatcctggctttggctgctggattataggcgttgacgtgaacacacagcaaagttttgaagcactctcggatcgcgccgtggctgttgtggtagatccgattcaatccgtcaagggaaaggtcgtgatcgatgccttccgtacgatcagtcagcaaacaattgcattgaatcaggaaccacgccagacaacnagcaanattggccatctgcagaaaccttcaatccaggcgctaattcatggactnaacngacactattattcaattcccattgcctatcgcatcagcgaaaacgaacaacagntnttnnngnatntgaacaagcaaagctggatggatgcaatgagcttggaaaaatacagtgtccactgtggttctaccgagaagcaggcggctgagatattgaaacaagccaaactgtacaagaagtcattggaagaagaggagaagatgaccgacgaacaactggccatcaagaatgtgggcaagcaagaccctaagcgccatttaggtgacaccgtcaacgcaatgctcgccgataatctggtgcagagtctggctgcgcagttgnnnnnnnnnnnnnnnnnnnnn

SEQ ID NO: 809 - DNA, 1473 bp, Artificial Sequence
  Description of Artificial Sequence: Synthetic polynucleotide
  modified_base (1)..(192): a, c, t, g, unknown or other
  modified_base (588)..(588): a, c, t, g, unknown or other
  modified_base (615)..(616): a, c, t, g, unknown or other
  modified_base (618)..(618): a, c, t, g, unknown or other
  modified_base (620)..(622): a, c, t, g, unknown or other
  modified_base (624)..(624): a, c, t, g, unknown or other
  modified_base (709)..(711): a, c, t, g, unknown or other
  modified_base (847)..(1113): a, c, t, g, unknown or other
  modified_base (1192)..(1192): a, c, t, g, unknown or other
  modified_base (1218)..(1218): a, c, t, g, unknown or other
  modified_base (1222)..(1222): a, c, t, g, unknown or other
  modified_base (1248)..(1248): a, c, t, g, unknown or other
  modified_base (1279)..(1279): a, c, t, g, unknown or other
  modified_base (1441)..(1473): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatcgaatcccttcaacaacttgagaagaaaagtcgcctcgactgtgatatgaaatcaaacattcgggtcactcgccacatggtcaagctggcctacgacgccaaacaatgggatctgctttgtgacaccattcgggcactttgcaaaaagcgggcgctcatcaaaatgagcatcaaaacaatgatccaagactgctgtgagatgattgacaacacaccagacgaagccaccaaaaccaaactcattgacactcttcgaacagtgacagctggaaagatttatgtggaggttgaaagagcccgtctcaccaaacgtgttgcggataaattggaagcagagggtaaaattgaagaggcgcgtgaaatgatcatggaattgcaagttgagacatanggctcgatgctgattaatgagaaggtnnantnnntnctccatcagatgcgactctccattaccaaacaggattttatcagggcaaccataatttcgcgcaaaataagcgccaaattctttnnngagaacgacagcgaagaggttcagcaaatgaaattggaatactacaaatacatggtgcagattgggctgcacgattgcgcgtatttggatgtttgcaaacacttcaatgccatcttcaaaacaccatcccttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggccaaaagcgcaaggatcggctgcacgactgtgtgggcgagcacaatgtgcgcatgattgccaactactacacgnggatcagcttcaaacgaatggcacanctgntggagttcagcgtcgagcaaatgganacttttgtgtgcaaactgattgttgagggcntcatcccggatgtgaaaatccatcgtccatcgcaaatcatctacctcagcccaaaacgatccacaattgacgtgctggatgagtggggctcaaatgtgcgcaaactgacggccatcatgaaccaggtgtcgcatctgatcctcaaagaagagatggtccatnnnnnnnnnnnnnnnnnnnnnnnnnnnnnnnnn

SEQ ID NO: 810 - DNA, 1317 bp, Artificial Sequence
  Description of Artificial Sequence: Synthetic polynucleotide
  modified_base (1)..(630): a, c, t, g, unknown or other
  modified_base (991)..(993): a, c, t, g, unknown or other
  modified_base (1176)..(1176): a, c, t, g, unknown or other
  modified_base (1183)..(1185): a, c, t, g, unknown or other
  modified_base (1312)..(1317): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagctttaagcgtgtttatgcgccaatgttttcaggccaaactcgatctccagtctgggattttgcatgcagccgatgaacgcgacttcaagaccgcctattcatatttctacgaggcctttgaagcttttgactccgtcaacgagagtaaactggcccagcaatcactgaagtacatgctgcttagcaaaataatgaccgacaatgctgatgaggtgaacagcattttggctggcaaaactgcgaccaaatactcgagcaaagaagctgaggccatgcgcgctcttgctgatgcttcaaagaagcgctctcttggagaattcaatgaagcattcaagaacttcaaaaaccgagctggannntgaccggtgatccagaagcacttttccgccatttcggatgccatgttcgagaaggagctgtcccgactgattcagccatactccagtgttcaagtggagcacattgccaaatcagtgggccttgaccgcgcaaaagtggagaggaagctgagccaaatgattttggaccagaaattctcagantgcttgnnncaaggagatgggctgctcgtcattttcgagaaagagcccgtggaccatttgttcgaattggccgtcgagacaatacacgcaatgggagaggtggttgacgcactctgtgaacgagcgaagaaagtcnnnnnn

SEQ ID NO: 811 - DNA, 1233 bp, Artificial Sequence
  Description of Artificial Sequence: Synthetic polynucleotide
  modified_base (1)..(174): a, c, t, g, unknown or other
  modified_base (198)..(198): a, c, t, g, unknown or other
  modified_base (231)..(231): a, c, t, g, unknown or other
  modified_base (235)..(235): a, c, t, g, unknown or other
  modified_base (249)..(249): a, c, t, g, unknown or other
  modified_base (264)..(264): a, c, t, g, unknown or other
  modified_base (318)..(318): a, c, t, g, unknown or other
  modified_base (327)..(327): a, c, t, g, unknown or other
  modified_base (329)..(329): a, c, t, g, unknown or other
  modified_base (732)..(732): a, c, t, g, unknown or other
  modified_base (1006)..(1233): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaagaaaacgaaatggctccnttctacgagcaagtttgtgctcatttgaatatncccntcgatgaagctctnatgaagcaactcaangaaaagaacaaagtgcggcttgacgaaattgataagcaaattgaagatgcgganaagaatctngntgagagtgaggtgcgccaagcgtggctagcaaagtccgaatatctctgcaaaattggtgacaaaacaaacgcggtctccgcatttcggcagactttcgacaaaactgttggcgttggttatcgcattgacctggtcttcaacctcatccgtattggcctcttcttcatggaccatgaattgatcaccaccaacattgagaaggcaaaggagctgatggaaaagggtggtgattgggaccgcaaaaatcgtcttcgttcctatgaaggtctttacaaaatggccatcagagacatgaagggagcagccgaacttcttctcgaagccgtcccaacatttggtgcctatgaactgatgacttacgaggacctgattttctactcagtcgtcactgccgtcctcgtnctggaccgacccgatttgaaagagaaagttgtgaattgcagcgacattttgcagcagttgaatgccgaaggagagaacaacgcctatttgccgttgaagaatctgatgaacactttcttcgcctgtgactatgaccatttcatgaaggcattggccaaactggagcgagactttctcctcaaggatcgctatctcaaggcccatttccaattctacacgcgcgcaatgcgtgtcaaggcttatcagcaatttctggcgccatacaaatcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 812 - DNA, 1089 bp, Artificial Sequence
  Description of Artificial Sequence: Synthetic polynucleotide
  modified_base (1)..(114): a, c, t, g, unknown or other
  modified_base (135)..(137): a, c, t, g, unknown or other
  modified_base (139)..(140): a, c, t, g, unknown or other
  modified_base (142)..(142): a, c, t, g, unknown or other
  modified_base (265)..(265): a, c, t, g, unknown or other
  modified_base (267)..(267): a, c, t, g, unknown or other
  modified_base (630)..(630): a, c, t, g, unknown or other
  modified_base (940)..(1089): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggttgtggtccacccnnntnntntgctcagtgttgtggatcacttcaatcgcattcataagagccaaaaagttaagcgagttgttggtgttctgctgggcagcatgaagtttgacaaatcgctggacattgcgaattgttttgccntnccttatgatgaagattccgaggatccgagcattttcttcttggatgccgactatctcgaagacatgttcggcatgttctacaaagttgcagcgcgagagaaaatcattggttggtaccacacaggacccagactttgcaagaacgacattgacatcaacaaggtgatgaagcgttttacgccaaatcccgttttggtcatcatccaagcagcacagggcaacttggctttgccaacggatgcttatgtggaagttcaagaagttcacgatgatggaacgcccccaatcagcacctttgagcacgtccccagtgaaattggagcggaagaggctgaggaggtgggagtggagcatctcataggngacatcaagaatcagacagctggaacactctctcaacggatcaccaaccaactgatgggtcttcgcggcttccaaagtcacttggccggcgcaaccagttacttgcatcgtgtcgcaaaacgtgaactgccctacaatcaggcaatcattgaccaaattcaggaaatgcggaatctgctgccggatgtgatggaagccgaactggtggatacccagaacataatggccaacgatcatcaaatgtgcatctacttgggcaatttggtgcgcactgtcattgctttgcacaacttgattgacaacaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 813 - DNA, 1164 bp, Artificial Sequence
  Description of Artificial Sequence: Synthetic polynucleotide
  modified_base (1)..(426): a, c, t, g, unknown or other
  modified_base (772)..(858): a, c, t, g, unknown or other
  modified_base (1066)..(1164): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgattgagtcaacggcacagaaaatgaacaaacttgtggaggttgggccagtgcaggcggccttttacaaagttgcggccgcctatcagcaacaagtggccaactacgctggctattacaccgacgcactgcgctatttgggatgcgaagacttgcaaaatcttttaccagaggaacaacgccaacaagcactccatctttccgtggccgcacttcttggcgagaatgtgtacaattttgggaattggttggctcatcccattcttaaggctctcgagggcggtccaaagagttggcttatcgatgtgctacaatcgttgaatgccggcgattggaacgcattcnnnnnnnnnnnnnnnnnnnnnnnnnnnnnnnnnnnnnnnnnnnnnnnnnnnnnnnnnnnnnnnnnnnnnnnnnnnnnnnnnnnnnnngttaagatggcagtgaaattgcctccgaagcagcggactctctcttttgacaaaattgcaaagggcgcacacttgggtgaggacgaagtggaattgcttctgatgaaggccctggccaaaggacttatccgcggcaaaatagatcaagtcagcggcatcgtcaacattgagtgggtgcagccgcgcgtgctctccaccgatcaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 814 - DNA, 456 bp, Artificial Sequence
  Description of Artificial Sequence: Synthetic polynucleotide
  modified_base (40)..(42): a, c, t, g, unknown or other
  modified_base (336)..(336): a, c, t, g, unknown or other
  modified_base (454)..(456): a, c, t, g, unknown or other
atgggacggatgcacaacccaggaaagggcatttcccgcnnngcgctgccctatcgccgttcggtgcccacttggcagaagctgaccagccaggatgtcgaggaacaaatcgtgaaacttgcgcgcaagggtcttcgcccttcccaaattggcgtcatccttcgtgactcgcacggcgttgcccaggtgcgtcgcatcaccggcaacaagattgtgcgcatcctcagatccaagggtatggcaccggagattccggaggatctttaccatctgatcaagaaggccgtcagcatccgcaaacacttggaacgcttccgcaaggacattgactcgaantaccgcctgatcttggtggagtctcgcatccatcgcttggcccgctactacaaaaccaagcgtcagttgccgcccacctggaagtacgaggcccaaaccgcatccgcactggtctcgnnn

SEQ ID NO: 815 - DNA, 1308 bp, Artificial Sequence
  Description of Artificial Sequence: Synthetic polynucleotide
  modified_base (78)..(78): a, c, t, g, unknown or other
  modified_base (202)..(202): a, c, t, g, unknown or other
  modified_base (207)..(209): a, c, t, g, unknown or other
  modified_base (216)..(216): a, c, t, g, unknown or other
  modified_base (219)..(220): a, c, t, g, unknown or other
  modified_base (224)..(225): a, c, t, g, unknown or other
  modified_base (228)..(228): a, c, t, g, unknown or other
  modified_base (231)..(232): a, c, t, g, unknown or other
  modified_base (234)..(237): a, c, t, g, unknown or other
  modified_base (241)..(241): a, c, t, g, unknown or other
  modified_base (246)..(246): a, c, t, g, unknown or other
  modified_base (249)..(249): a, c, t, g, unknown or other
  modified_base (252)..(252): a, c, t, g, unknown or other
  modified_base (259)..(266): a, c, t, g, unknown or other
  modified_base (269)..(272): a, c, t, g, unknown or other
  modified_base (275)..(278): a, c, t, g, unknown or other
  modified_base (280)..(280): a, c, t, g, unknown or other
  modified_base (282)..(282): a, c, t, g, unknown or other
  modified_base (284)..(285): a, c, t, g, unknown or other
  modified_base (287)..(291): a, c, t, g, unknown or other
  modified_base (293)..(293): a, c, t, g, unknown or other
  modified_base (296)..(296): a, c, t, g, unknown or other
  modified_base (299)..(301): a, c, t, g, unknown or other
  modified_base (303)..(303): a, c, t, g, unknown or other
  modified_base (305)..(305): a, c, t, g, unknown or other
  modified_base (311)..(311): a, c, t, g, unknown or other
  modified_base (313)..(315): a, c, t, g, unknown or other
  modified_base (317)..(319): a, c, t, g, unknown or other
  modified_base (321)..(323): a, c, t, g, unknown or other
  modified_base (327)..(332): a, c, t, g, unknown or other
  modified_base (334)..(335): a, c, t, g, unknown or other
  modified_base (337)..(337): a, c, t, g, unknown or other
  modified_base (341)..(343): a, c, t, g, unknown or other
  modified_base (346)..(346): a, c, t, g, unknown or other
  modified_base (348)..(349): a, c, t, g, unknown or other
  modified_base (351)..(351): a, c, t, g, unknown or other
  modified_base (353)..(353): a, c, t, g, unknown or other
  modified_base (355)..(356): a, c, t, g, unknown or other
  modified_base (358)..(359): a, c, t, g, unknown or other
  modified_base (362)..(363): a, c, t, g, unknown or other
  modified_base (375)..(375): a, c, t, g, unknown or other
  modified_base (377)..(378): a, c, t, g, unknown or other
  modified_base (383)..(388): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (401)..(402): a, c, t, g, unknown or other
  modified_base (408)..(408): a, c, t, g, unknown or other
  modified_base (411)..(411): a, c, t, g, unknown or other
  modified_base (426)..(426): a, c, t, g, unknown or other
  modified_base (429)..(440): a, c, t, g, unknown or other
  modified_base (442)..(442): a, c, t, g, unknown or other
  modified_base (654)..(654): a, c, t, g, unknown or other
  modified_base (657)..(657): a, c, t, g, unknown or other
  modified_base (660)..(660): a, c, t, g, unknown or other
  modified_base (663)..(663): a, c, t, g, unknown or other
  modified_base (669)..(669): a, c, t, g, unknown or other
  modified_base (675)..(675): a, c, t, g, unknown or other
  modified_base (684)..(684): a, c, t, g, unknown or other
  modified_base (687)..(687): a, c, t, g, unknown or other
  modified_base (693)..(693): a, c, t, g, unknown or other
  modified_base (696)..(696): a, c, t, g, unknown or other
  modified_base (702)..(702): a, c, t, g, unknown or other
  modified_base (705)..(705): a, c, t, g, unknown or other
  modified_base (708)..(708): a, c, t, g, unknown or other
  modified_base (717)..(717): a, c, t, g, unknown or other
  modified_base (723)..(723): a, c, t, g, unknown or other
  modified_base (739)..(739): a, c, t, g, unknown or other
  modified_base (759)..(759): a, c, t, g, unknown or other
  modified_base (801)..(801): a, c, t, g, unknown or other
  modified_base (813)..(813): a, c, t, g, unknown or other
  modified_base (825)..(825): a, c, t, g, unknown or other
  modified_base (830)..(830): a, c, t, g, unknown or other
  modified_base (873)..(873): a, c, t, g, unknown or other
  modified_base (900)..(900): a, c, t, g, unknown or other
  modified_base (951)..(951): a, c, t, g, unknown or other
  modified_base (1038)..(1038): a, c, t, g, unknown or other
  modified_base (1041)..(1041): a, c, t, g, unknown or other
  modified_base (1044)..(1045): a, c, t, g, unknown or other
  modified_base (1047)..(1049): a, c, t, g, unknown or other
  modified_base (1055)..(1057): a, c, t, g, unknown or other
  modified_base (1059)..(1062): a, c, t, g, unknown or other
  modified_base (1064)..(1064): a, c, t, g, unknown or other
  modified_base (1071)..(1071): a, c, t, g, unknown or other
  modified_base (1073)..(1073): a, c, t, g, unknown or other
  modified_base (1077)..(1077): a, c, t, g, unknown or other
  modified_base (1081)..(1082): a, c, t, g, unknown or other
  modified_base (1086)..(1086): a, c, t, g, unknown or other
  modified_base (1088)..(1089): a, c, t, g, unknown or other
  modified_base (1095)..(1095): a, c, t, g, unknown or other
  modified_base (1098)..(1098): a, c, t, g, unknown or other
  modified_base (1105)..(1105): a, c, t, g, unknown or other
  modified_base (1107)..(1107): a, c, t, g, unknown or other
  modified_base (1116)..(1116): a, c, t, g, unknown or other
  modified_base (1119)..(1119): a, c, t, g, unknown or other
  modified_base (1122)..(1122): a, c, t, g, unknown or other
  modified_base (1126)..(1126): a, c, t, g, unknown or other
  modified_base (1128)..(1128): a, c, t, g, unknown or other
  modified_base (1131)..(1132): a, c, t, g, unknown or other
  modified_base (1134)..(1134): a, c, t, g, unknown or other
  modified_base (1144)..(1144): a, c, t, g, unknown or other
  modified_base (1203)..(1203): a, c, t, g, unknown or other
  modified_base (1276)..(1276): a, c, t, g, unknown or other
  modified_base (1280)..(1280): a, c, t, g, unknown or other
  modified_base (1284)..(1284): a, c, t, g, unknown or other
  modified_base (1306)..(1308): a, c, t, g, unknown or other
atgcctgatcacttgggagatgatatgcgcaaagtaaaggacggatcggatgagaccactaaagaagaagttaaagtnttgggcgaagaggaaatcgctgccctgaaaagctacaacatggggccttattcggagaaattgcgtcaagtggagaaggacattgaggaggcgatgaagggcataaacaccctttgcggtgtcnaggannntgacacnggnntggnnccnccnncnnnntggnacctngcngcngacaaannnnnnnnggnnnnggnnnnancncnncnnnnngnaanatnnncnanaatcanannngnnnannnacannnnnntnncnacannntananntnangnnanncgnnaaattcgttgtngnnctggnnnnnncngtngcnccaanngacatngangaggggatgcgggtnggnnnnnnnnnnnnanattaacagatccatctcccgctgcctgccaaaatcgacccaaccgtgaccatgatgcaagtggaggaaaagccggatatcacttatgcggatgtgggcggctgcaaagaacaaattgaaaagctccgcgaagtcgttgaaatgccacttctccaccccgagcgctttgtcgacattgggattgaaccgcccaaaggagtgttgttctacggnccnccnggnactggnaaaacnctttgcgcncgngcggtngcnaatcgnacngangcttgcttnattcgngtcatcgggtcggaantggtgcaaaagtacgtgggngaaggcgcccgcatggttcgtgaacttttcgaaatggcaaanagcaagaaagcntgcatcattttnttcgncgaaattgacgcttttggcggtgcgcgcttcgacagcgaagtngggaacgacaacgaagtgaacagaacnatgctggaattggtcaaccagttggacggctttgactcgcgcggagcaatnaaggtgatcatggccaccaatcgcccggacacattggacccagcactcgtgagaccggggcgagttgatcggcgcattgagtttggnttnccnnannncgaggnnngnnnnancatcctnanaatncacnngaanannatgagngtngacaggnanattcgctanganctnattncncgnntntgcccgaacncgacagctgccgatatccgttcagtttgcaccgaggcaggcatgtttgcgttgcgagcncgtcgcaaggtgatcaccgagaaggacttcttggatgctgttcagaaagtggtaagttccgctgaattatttngttncacncccagctacatgacgcacaacnnn

SEQ ID NO: 816 - DNA, 1377 bp, Artificial Sequence
  Description of Artificial Sequence: Synthetic polynucleotide
  modified_base (1)..(93): a, c, t, g, unknown or other
  modified_base (420)..(420): a, c, t, g, unknown or other
  modified_base (876)..(876): a, c, t, g, unknown or other
  modified_base (1011)..(1011): a, c, t, g, unknown or other
  modified_base (1047)..(1047): a, c, t, g, unknown or other
  modified_base (1056)..(1056): a, c, t, g, unknown or other
  modified_base (1074)..(1074): a, c, t, g, unknown or other
  modified_base (1101)..(1101): a, c, t, g, unknown or other
  modified_base (1107)..(1107): a, c, t, g, unknown or other
  modified_base (1161)..(1161): a, c, t, g, unknown or other
  modified_base (1168)..(1377): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagttgctgcccacagccatgtgaaaggcctcggattggatgaggaaagtggccaagcgttggacaaagcacacggcttcattggacaatgcgaggcacgcgaagcggccggtgtcattgttgagttggtgcgccaaaagaaaatggcaggacgcgccgtgcttttggctgggcctcccgggactggcaagaccgcaattgcaatggcgatggcccaagagttgggcgacaaagtgccatttgtgccgctggtcgggtccgaagtgttctcgagtgaagtgaaaaagaccgaagtgctcatggagaacctgcggcgtgcaatcgtnctccgcgtcaaagagaagaaggaggttttcgagggcgaagtggtcgacttgacaccgatggagacggaaaacccaggcggctatgggaagacggtgtcgcatgtgctgtgcaccctgaaaaccacaaaaggctcgcgcgaacttcggcttgatcccagcatttacgactcgtttttgaagcaaaaagttgcggtcggggatgtcatctacattgaggccgggtctggcacagtcaagagaatgggacgctccgacattttcgccaacgaattcgacttggacgccgacgagtttgtgccaatgccgaaaggggatgtgcacaaaaccaaggagttacagcagtttgtcagcctccacgatttcgacgcagccaacgcaacgccgcatggcaaagcgggcgatgtaatgtccatgctgtcgcaaattttgaagccgaagaagacggaaattacaganaaactccgagccgaagtcaacaaagttgtgaaccagctgattgatgcgggacaagccgaactgctccccggcgtgctattcatcgacgaagtgcacatgctggacatggagtgcttcacattcctgcacagggcnctcgagtccgaagtgaacccgatcattgtgttcgcnacaaaccgngggcgcgtcaaaatcagnaattccgaagagcttgcattctacggnatcccntcggacttgatcgaccgcctgctgatcgtgcccaccaagctgtactccccggangaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 817 - DNA, 1347 bp, Artificial Sequence
  Description of Artificial Sequence: Synthetic polynucleotide
  modified_base (93)..(93): a, c, t, g, unknown or other
  modified_base (123)..(123): a, c, t, g, unknown or other
  modified_base (165)..(165): a, c, t, g, unknown or other
  modified_base (168)..(168): a, c, t, g, unknown or other
  modified_base (171)..(171): a, c, t, g, unknown or other
  modified_base (243)..(243): a, c, t, g, unknown or other
  modified_base (303)..(303): a, c, t, g, unknown or other
  modified_base (324)..(324): a, c, t, g, unknown or other
  modified_base (345)..(345): a, c, t, g, unknown or other
  modified_base (408)..(408): a, c, t, g, unknown or other
  modified_base (423)..(423): a, c, t, g, unknown or other
  modified_base (435)..(435): a, c, t, g, unknown or other
  modified_base (450)..(450): a, c, t, g, unknown or other
  modified_base (465)..(465): a, c, t, g, unknown or other
  modified_base (468)..(468): a, c, t, g, unknown or other
  modified_base (483)..(483): a, c, t, g, unknown or other
  modified_base (588)..(588): a, c, t, g, unknown or other
  modified_base (747)..(747): a, c, t, g, unknown or other
  modified_base (904)..(904): a, c, t, g, unknown or other
  modified_base (916)..(916): a, c, t, g, unknown or other
  modified_base (918)..(918): a, c, t, g, unknown or other
  modified_base (924)..(925): a, c, t, g, unknown or other
  modified_base (927)..(928): a, c, t, g, unknown or other
  modified_base (930)..(934): a, c, t, g, unknown or other
  modified_base (936)..(936): a, c, t, g, unknown or other
  modified_base (945)..(946): a, c, t, g, unknown or other
  modified_base (949)..(951): a, c, t, g, unknown or other
  modified_base (954)..(954): a, c, t, g, unknown or other
  modified_base (957)..(958): a, c, t, g, unknown or other
  modified_base (960)..(960): a, c, t, g, unknown or other
  modified_base (964)..(964): a, c, t, g, unknown or other
  modified_base (966)..(966): a, c, t, g, unknown or other
  modified_base (969)..(969): a, c, t, g, unknown or other
  modified_base (976)..(976): a, c, t, g, unknown or other
  modified_base (981)..(984): a, c, t, g, unknown or other
  modified_base (987)..(987): a, c, t, g, unknown or other
  modified_base (990)..(990): a, c, t, g, unknown or other
  modified_base (994)..(994): a, c, t, g, unknown or other
  modified_base (997)..(1000): a, c, t, g, unknown or other
  modified_base (1003)..(1012): a, c, t, g, unknown or other
  modified_base (1015)..(1018): a, c, t, g, unknown or other
  modified_base (1020)..(1020): a, c, t, g, unknown or other
  modified_base (1023)..(1023): a, c, t, g, unknown or other
  modified_base (1026)..(1026): a, c, t, g, unknown or other
  modified_base (1029)..(1029): a, c, t, g, unknown or other
  modified_base (1031)..(1031): a, c, t, g, unknown or other
  modified_base (1035)..(1035): a, c, t, g, unknown or other
  modified_base (1039)..(1039): a, c, t, g, unknown or other
  modified_base (1048)..(1050): a, c, t, g, unknown or other
  modified_base (1053)..(1053): a, c, t, g, unknown or other
  modified_base (1057)..(1057): a, c, t, g, unknown or other
  modified_base (1059)..(1062): a, c, t, g, unknown or other
  modified_base (1067)..(1070): a, c, t, g, unknown or other
  modified_base (1075)..(1076): a, c, t, g, unknown or other
  modified_base (1078)..(1080): a, c, t, g, unknown or other
  modified_base (1099)..(1347): a, c, t, g, unknown or other
atggcagaaattggaaattttgaaattaaaaacatctcaaagattgaacgtattggcgcacattcccacattgttgggcttggtctcaaatcnaattatgaaccttttcctattgccgaaggnatggttggtcaacatgcggccaggaaagcagcaggtttgatngtnaanatgataaaggttggacaaattgctggtagagccttgttgattgttggagagccaggcactggcaaaacagcngtggccatgggtatttcaaagtcaattggtgaaggcaccccatttgtgtcaatttctgcnagtgaagtgtactcaatgganatgagcaaaaccgaggcattnacccaagcattcaggaaagcaatgggcgtgcgaattaaagaggaaaccgaggtactccgaggngaagttgtccatgtngagattgaccgnccggcaacgggaatngggcctaaagttggnaanttgacacttaaaacnacagatatggaggccatctatgacattggaagcaaaatgacagaatctgtaatcaaagcgcgtatcacaccgggagatgtcatccaaattgataaagcaaccganaagattgaaaagatcggacgatcccaagcaaaatcaaaagactatgatgcccttggtccgcaggttaaacttgtggcttgtccttccggcgaaatccagtcaagaatggaaacagagaacacaatttccctacacgatattgatgtgatcaattcagtntcacatggatatcttgccgtgttttcaggcgataccggggaaatcaagaatgaagtgcgcgaacaaatcaacaaaaaggtgatggaatggcgtgaagagaacaaggcacagttgattccgggcgtactgtttgttgatgaggcgcacatgctcgacntggagtgcttcncnttcctnnanngnnnnntngagtccganntgnnnccnatnntngtgntngcnacaaacnggggnnnngtnaanatcngcnnnnccnnnnnnnnnncannnnanggnatnccntngganttgntcgaccgcnnnctnatcntnnnnaccannnngtacnncnnngaggaaatgtccctggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 818 - DNA, 582 bp, Artificial Sequence
  Description of Artificial Sequence: Synthetic polynucleotide
  modified_base (1)..(72): a, c, t, g, unknown or other
  modified_base (352)..(354): a, c, t, g, unknown or other
  modified_base (465)..(465): a, c, t, g, unknown or other
  modified_base (580)..(582): a, c, t, g, unknown or other
nnnnnnnnnnnnnnnnnnnnnnnnnnnnnnnnnnnnnnnnnnnnnnnnnnnnnnnnnnnnnnnnnnnnnnnngtcttcctcggccttgacaatgccggcaaaaccacactgctgcacatgctgaaagacgatcggattgcccagcacgtgcccacactgcatcccacttcggaggaactctcgctgggcggcattcgcttcacaacgttcgatctgggcggccacgttcaagcgcgcagggtttggaagagctatttcccggcactggacgccatcgtctttctcgtcgacgttgccgacctggaacgcatccaagaggccagggaggaactgtggagtctgcttcaggacnnncaagtgtcaagtgcgcccgtgctcattctcggcaacaaaattgacaaaccgaatgcattgagcgaggaccaaatcaaatactacttgggtgttcagcaatattgcacaganaaaggaaatgtctctcgcgccgatttggccacgcgtccattggaggtgttcatgtgctcggtgctgcgccgccaaggctatggcgaaggattccgctggctttcccaatatttgnnn

SEQ ID NO: 819 - DNA, 897 bp, Artificial Sequence
  Description of Artificial Sequence: Synthetic polynucleotide
  modified_base (1)..(147): a, c, t, g, unknown or other
  modified_base (210)..(210): a, c, t, g, unknown or other
  modified_base (237)..(237): a, c, t, g, unknown or other
  modified_base (249)..(249): a, c, t, g, unknown or other
  modified_base (258)..(258): a, c, t, g, unknown or other
  modified_base (261)..(261): a, c, t, g, unknown or other
  modified_base (279)..(279): a, c, t, g, unknown or other
  modified_base (282)..(282): a, c, t, g, unknown or other
  modified_base (330)..(330): a, c, t, g, unknown or other
  modified_base (336)..(336): a, c, t, g, unknown or other
  modified_base (378)..(378): a, c, t, g, unknown or other
  modified_base (441)..(441): a, c, t, g, unknown or other
  modified_base (859)..(897): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaccaaatgtaaagacttttgaagtatatcgatacaatccggaaacaccagaagtcaagccntttctccagaaatatgacatagagttngacaagtgcggncctatggtnttngacgcgctaatcaaaatnaanaatgaagttgatccaacacttacgtttcggcgctcttgcagagaaganatctgnggttcttgttcaatgaatattaatggagagaacacattggcntgtatcagtcatattgacaaaaacacttcgaaatcaacaaaaattaggccacttccacacgtntacgtcgtgaaggaccttgtgccggacatgaatcttttctacgagcaatatcgatcagttcaaccatggatccagaagaatgttccattgaaactgggcgagaaagaactccaccaaagtgtggacgagcgtgcaaaattggatggtctttatgagtgcattttgtgcgcttgttgcagcacttcttgcccctcgtattggtggaatccagacaaatacatgggcccgaaaatataataagttaatgtcagatggataattgactcgcgggatgacaaatacaaagagcgactttcgcgcctgaccgatccattcagcgcctttaaatgccacaccatcctcaattgcaccaaaacatgtcctaagcatctaaatccagcgaaggcgattagcgagatcaaaacattgttgaccggannnnnnnnnnnnnnnnnnnnnnnnnnnnnnnnnnnnnnn

SEQ ID NO: 820 - DNA, 276 bp, Artificial Sequence
  Description of Artificial Sequence: Synthetic polynucleotide
  modified_base (1)..(36): a, c, t, g, unknown or other
  modified_base (121)..(121): a, c, t, g, unknown or other
  modified_base (123)..(124): a, c, t, g, unknown or other
  modified_base (159)..(159): a, c, t, g, unknown or other
  modified_base (173)..(173): a, c, t, g, unknown or other
  modified_base (250)..(276): a, c, t, g, unknown or other
nnnnnnnnnnnnnnnnnnnnnnnnnnnnnnnnnnnngagtacatcaaactcaaggtggtcggacaggactccaacgaagtccatttccgagtcaagtacgggaccagcatggggaagctgnannaggcgtacgccgagcgaactggagtcgcggtcggntctctgcgctttcncttcgacggacgacgtctcaacgacgaggacaccccgaaaagcttggaaatggaggaagacgacgtcattgaggttnnnnnnnnnnnnnnnnnnnnnnnnnnn

SEQ ID NO: 821 - DNA, 357 bp, Artificial Sequence
  Description of Artificial Sequence: Synthetic polynucleotide
  modified_base (1)..(39): a, c, t, g, unknown or other
  modified_base (183)..(183): a, c, t, g, unknown or other
  modified_base (186)..(186): a, c, t, g, unknown or other
  modified_base (193)..(193): a, c, t, g, unknown or other
  modified_base (196)..(196): a, c, t, g, unknown or other
  modified_base (198)..(199): a, c, t, g, unknown or other
  modified_base (204)..(204): a, c, t, g, unknown or other
  modified_base (207)..(207): a, c, t, g, unknown or other
  modified_base (211)..(212): a, c, t, g, unknown or other
  modified_base (216)..(216): a, c, t, g, unknown or other
  modified_base (225)..(225): a, c, t, g, unknown or other
  modified_base (230)..(230): a, c, t, g, unknown or other
  modified_base (233)..(233): a, c, t, g, unknown or other
  modified_base (242)..(243): a, c, t, g, unknown or other
  modified_base (247)..(247): a, c, t, g, unknown or other
  modified_base (253)..(254): a, c, t, g, unknown or other
  modified_base (256)..(259): a, c, t, g, unknown or other
  modified_base (263)..(276): a, c, t, g, unknown or other
  modified_base (328)..(357): a, c, t, g, unknown or other
nnnnnnnnnnnnnnnnnnnnnnnnnnnnnnnnnnnnnnngaagagttggcggccgagcaggacgaggagttcaacatcggcccgctctcgatgctgacctattcgatgcgcaacaagaccgaggtgctgatcagctgccgcaacaacaagaagctgctgggcaaaatcaaggctttcgaccgncantgcaacntgntnntggangangtcnngganatgtggacngagangcngaagaaggnnaaangcaagnngnnnnccannnnnnnnnnnnnngaccggttcattccgaagctgtttgtgcgcggggacagcgtcattctggttnnnnnnnnnnnnnnnnnnnnnnnnnnnnnn

SEQ ID NO: 822 - DNA, 258 bp, Artificial Sequence
  Description of Artificial Sequence: Synthetic polynucleotide
  modified_base (1)..(3): a, c, t, g, unknown or other
  modified_base (10)..(10): a, c, t, g, unknown or other
  modified_base (12)..(15): a, c, t, g, unknown or other
  modified_base (18)..(19): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (43)..(44): a, c, t, g, unknown or other
  modified_base (48)..(50): a, c, t, g, unknown or other
  modified_base (54)..(54): a, c, t, g, unknown or other
  modified_base (59)..(61): a, c, t, g, unknown or other
  modified_base (63)..(63): a, c, t, g, unknown or other
  modified_base (66)..(68): a, c, t, g, unknown or other
  modified_base (78)..(78): a, c, t, g, unknown or other
  modified_base (85)..(90): a, c, t, g, unknown or other
  modified_base (93)..(94): a, c, t, g, unknown or other
  modified_base (98)..(98): a, c, t, g, unknown or other
  modified_base (100)..(100): a, c, t, g, unknown or other
  modified_base (102)..(102): a, c, t, g, unknown or other
  modified_base (108)..(109): a, c, t, g, unknown or other
  modified_base (111)..(114): a, c, t, g, unknown or other
  modified_base (117)..(117): a, c, t, g, unknown or other
  modified_base (122)..(123): a, c, t, g, unknown or other
  modified_base (129)..(130): a, c, t, g, unknown or other
  modified_base (135)..(136): a, c, t, g, unknown or other
  modified_base (138)..(139): a, c, t, g, unknown or other
  modified_base (141)..(143): a, c, t, g, unknown or other
  modified_base (145)..(148): a, c, t, g, unknown or other
  modified_base (150)..(150): a, c, t, g, unknown or other
  modified_base (152)..(152): a, c, t, g, unknown or other
  modified_base (155)..(155): a, c, t, g, unknown or other
  modified_base (201)..(201): a, c, t, g, unknown or other
  modified_base (235)..(258): a, c, t, g, unknown or other
nnnagtaccntnnnnccnntnaatccnaanccnttnctcaatnngctnnntggnaagcnnntngtnnncaagctgaantggggcnnnnnntanngagnantnctgatnncnnnnganggctnnatgaanntgcanntnncnnntnnnnangnatncattgatggcaccaatacgggcgcactcggtgaagtgctgatcagntgcaacaatgttctctggatctcgggtgccgagnnnnnnnnnnnnnnnnnnnnnnnn

SEQ ID NO: 823 - DNA, 273 bp, Artificial Sequence
  Description of Artificial Sequence: Synthetic polynucleotide
  modified_base (1)..(12): a, c, t, g, unknown or other
  modified_base (135)..(135): a, c, t, g, unknown or other
  modified_base (229)..(273): a, c, t, g, unknown or other
nnnnnnnnnnnnaaagtgcagaaagtgatggtgcagccaatcaacctgatcttccgttgtctccaaagccgttcccggatccagatttggctctacgagaacatcacctaccgcatcgaaggatacatcatcggnttcgacgagtacatgaacgttgtcattgacgaggctgaggagatcaacatgaagtcgctgaatcgccacaagctgggccgcattctgctcaagnnnnnnnnnnnnnnnnnnnnnnnnnnnnnnnnnnnnnnnnnnnnn

SEQ ID NO: 824 - DNA, 234 bp, Artificial Sequence
  Description of Artificial Sequence: Synthetic polynucleotide
  modified_base (186)..(186): a, c, t, g, unknown or other
  modified_base (229)..(234): a, c, t, g, unknown or other
atgagcaagacccatccgcccgagctgaagaagtacatggacaagcaggtgaacatcaagctgaatggcaacgggaacatctccggcgtgctgcgcggcttcgacccgttcatgaacattgtggttgaggactgcattgagcatctcaagagcggcgagtcccaaaccattggcatggtcgtggtncgcggcaacagcattgtcatcatggagcccatggaacgggttnnnnnn

SEQ ID NO: 825 - DNA, 666 bp, Artificial Sequence
  Description of Artificial Sequence: Synthetic polynucleotide
  modified_base (1)..(72): a, c, t, g, unknown or other
  modified_base (228)..(228): a, c, t, g, unknown or other
  modified_base (522)..(522): a, c, t, g, unknown or other
  modified_base (658)..(666): a, c, t, g, unknown or other
nnnnnnnnnnnnnnnnnnnnnnnnnnnnnnnnnnnnnnnnnnnnnnnnnnnnnnnnnnnnnnnnnnnnnnnnaaacacgcattgccggatctgccatatgactacaatgcactcgaaccagtcattgctaccgaaatcatgcaaatccaccatcaaaagcaccatgcgacttatgtgaataacctgaatatggcagaggagaaaacgcaggaggcactcgccaaagtngacattcgtaatgccatccaactccaaagcgcgttgaaattcaacggaggaggtcatatcaatcattgcatcttttggactaatctgtgcaaggaaggcggtgagccgagtggtcagattctgcaggccattaagaaggactttggttctattcaagccatgcaaaaccgtctgagtgccatgtctattgcggttcaaggatctggctggggttggcttggctacaacaaagaggacaaacgacttgaactcgcttgttgccccaatcaagatcctctggagccgaccactganctggtgcccttgtttggcattgacgtttgggagcatgcttactacatccaatacaagaatgttcgagctgactatgtcaaagcaatctggaagatcgctaattggaagaacattgaggaacgctaccagaatgcannnnnnnnn

SEQ ID NO: 826 - DNA, 1377 bp, Artificial Sequence
  Description of Artificial Sequence: Synthetic polynucleotide
  modified_base (1)..(153): a, c, t, g, unknown or other
  modified_base (505)..(507): a, c, t, g, unknown or other
  modified_base (510)..(510): a, c, t, g, unknown or other
  modified_base (586)..(586): a, c, t, g, unknown or other
  modified_base (829)..(864): a, c, t, g, unknown or other
  modified_base (960)..(960): a, c, t, g, unknown or other
  modified_base (976)..(1377): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgccccagaaccacgtgccattgaagggttcgtttcttgtacagtattttcaaattattccgttttaagaaaattcgtcaaatatgtcaacattgacggcaaaacatgtttgaatttggcttccaatgactttttagcgtttgttggcaatcagcgaattgaggagatagcccagaaaacaatctccaaatatggtgttggcgcttgcggacctcgaaatttttacggcactgttgatgttcatttggacctggagcgggaattggccgaatttttgggttgtgaagaagccatattatacagctacgggtttgccacgattgcaagtgccattccggcctattcaaaannnggngacatcatttttgccgacaaaggtgtcaattttgccattcaaaagggactggaagcgtcaaagagcagaattgttnggtttgaccacaatgatatggttcatctagaaaagcttttggaggagcaagcagagcaagacagaaaaaacccaaggaaagcggcagccatccgccgcttcatggtggtcgagggactctacgcaaaaacagctaccatttgccagttgccacgtttgattgaattgaaatggaaatacaaagtgcgcatttttatggacgagtcatactcattcggtgtgctcggaaaacatggaaaaggtnnnnnnnnnnnnnnnnnnnnnnnnnnnnnnnnnnnngatctcgtttccgcaacacttgaaaatgcaatggccaccactggaggcttctgcgcaggccgatcatttgtgattggccaccaacggttgtctgcncttggctattgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 827 - DNA, 1194 bp, Artificial Sequence
  Description of Artificial Sequence: Synthetic polynucleotide
  modified_base (1)..(120): a, c, t, g, unknown or other
  modified_base (220)..(221): a, c, t, g, unknown or other
  modified_base (252)..(252): a, c, t, g, unknown or other
  modified_base (303)..(303): a, c, t, g, unknown or other
  modified_base (342)..(342): a, c, t, g, unknown or other
  modified_base (378)..(378): a, c, t, g, unknown or other
  modified_base (394)..(394): a, c, t, g, unknown or other
  modified_base (396)..(396): a, c, t, g, unknown or other
  modified_base (398)..(398): a, c, t, g, unknown or other
  modified_base (435)..(435): a, c, t, g, unknown or other
  modified_base (558)..(558): a, c, t, g, unknown or other
  modified_base (567)..(567): a, c, t, g, unknown or other
  modified_base (687)..(687): a, c, t, g, unknown or other
  modified_base (693)..(693): a, c, t, g, unknown or other
  modified_base (765)..(765): a, c, t, g, unknown or other
  modified_base (943)..(945): a, c, t, g, unknown or other
  modified_base (951)..(951): a, c, t, g, unknown or other
  modified_base (954)..(954): a, c, t, g, unknown or other
  modified_base (962)..(963): a, c, t, g, unknown or other
  modified_base (969)..(969): a, c, t, g, unknown or other
  modified_base (973)..(973): a, c, t, g, unknown or other
  modified_base (975)..(975): a, c, t, g, unknown or other
  modified_base (984)..(985): a, c, t, g, unknown or other
  modified_base (987)..(987): a, c, t, g, unknown or other
  modified_base (990)..(990): a, c, t, g, unknown or other
  modified_base (992)..(992): a, c, t, g, unknown or other
  modified_base (996)..(996): a, c, t, g, unknown or other
  modified_base (999)..(1000): a, c, t, g, unknown or other
  modified_base (1005)..(1005): a, c, t, g, unknown or other
  modified_base (1008)..(1012): a, c, t, g, unknown or other
  modified_base (1014)..(1015): a, c, t, g, unknown or other
  modified_base (1017)..(1018): a, c, t, g, unknown or other
  modified_base (1022)..(1026): a, c, t, g, unknown or other
  modified_base (1029)..(1030): a, c, t, g, unknown or other
  modified_base (1032)..(1033): a, c, t, g, unknown or other
  modified_base (1189)..(1194): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattctggcccaaaatccgagacaaccctgacgcgcacagatgcgcttaaagaaattaaaaattttaagactgtccgacgcattgaaacttctgccgggnncatgtacaccgaaaagaaagtgcgcggattntgccatgagtctgtcggccaggaagcctctcctgttggaattgcttccacnctggagcggggtgatgccgtcataaatggatacagatgncatggttggacctatttgatgggcgccaccgtcacngatgtgctggccgagntnanagggcgcattaatggcaatgtgcatggcaaagggggntccatgcacatgtacaccaaaaacttcttcggcggccatggcattgtgggtgcgcaaatcccattgggcgttgggcttggcttctccaagaagtacaagaagcaagactttgtcagtgtgacnctgtacggngatggagcatcaaatcagggacaattctttgaagctgcaaacatggccgccctttggaagcttccggtgatgttcgtctgcgaaaacaatggcttcggaatgggcactcccgtccaacgngcttcngccgatccgcacatgttcaaccgactgaactatttgcccggcattttggtggatgccatgaacgtgctggcngtgcgcgaagctgctcgttttgcgcgcaaccattgtgtcaaggggaatgggccgattgtgttggaattggacacctaccgatttgtgggccattccgtgtcagacccgggcactgcgtatcgaactcgtgacgaaatccaagaggtgcgcaaaacacgcgatccaatcactggcttcnnngaccgnatnatcacggnngggctngtcnangaggagganntnaangnaatngannaagangtnnnnnannanntggnnnnngcnntnnaattggcacacaccgagggggagttgccaccggagggaatgtacaccgacatttacgcaaacactccgccccagtggattcggggcgttcagcctgggctgagtgttacgcagaagtacaccaacagcgaggaaatgatgaagggcattggcaaannnnnn

SEQ ID NO: 828 - DNA, 1332 bp, Artificial Sequence
  Description of Artificial Sequence: Synthetic polynucleotide
  modified_base (1)..(132): a, c, t, g, unknown or other
  modified_base (288)..(288): a, c, t, g, unknown or other
  modified_base (438)..(438): a, c, t, g, unknown or other
  modified_base (586)..(586): a, c, t, g, unknown or other
  modified_base (588)..(592): a, c, t, g, unknown or other
  modified_base (606)..(606): a, c, t, g, unknown or other
  modified_base (642)..(642): a, c, t, g, unknown or other
  modified_base (645)..(645): a, c, t, g, unknown or other
  modified_base (657)..(657): a, c, t, g, unknown or other
  modified_base (684)..(684): a, c, t, g, unknown or other
  modified_base (844)..(844): a, c, t, g, unknown or other
  modified_base (879)..(879): a, c, t, g, unknown or other
  modified_base (1008)..(1008): a, c, t, g, unknown or other
  modified_base (1018)..(1128): a, c, t, g, unknown or other
  modified_base (1261)..(1332): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgattatcccgccaaaggaccagattccgagagtggcaaaaatgcttgccgatgaatttggcacggcttcgaacatcaaatctcgagtgaacaggcaatccgtgctcggcgccatcacttccgtccaggctcgattaaaactttacaaccgaggncccgaaaatggtttggtcgtttattgcggcacaatcttgaccgaggatggaaaagagaagaaggtgaacattgactttgagcctttcaaacccgtgaacacgtcactctatttgtgcgacaacaaattccacacggaagcactgaacgtnttgctgattgatgacaacaagttcggattcattgtgatggacggaagcggatgtctgtttggcacactgcaaggcaatgccaaggaagtccttcacaaattctccgtggaattgccaaagaagcatggccgtggaggacaatcagcantnnnnnttgcccgactgagnatggaaaagcggcacaactatttgcgcaaagtggcnganatggccgtgganatgtacatcaagaacgacaaagtcacngtgacgggtcttgtgctcgctggaagtgctcaattcaaaacggagcttggacagtccgacatgttcgaccagagacttcaggcaaaaatcataaaaacagtggacatttcctacggaggcgagagcggcttcaacgaagccatcgagttggccgcggacncgctcaccgacgtcaagttcatcaaggagaagaanctgatcagctcatttttcgacgaaatttcccgggacaccaacaaagccatctacggagtcaacgagacgctggcagcattggaacaaggcgcggtggaaacactgatctgctgggagaatctggccatnctcaggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagcatcccactgctggagtggctcgcagaaaactacaagaaattcggcgctgtgctggagattgtcagcgacaagtcacaagagggtgctcagtttgtgcgcgggtttggtgggttgggaggtttgttgnnnnnnnnnnnnnnnnnnnnnnnnnnnnnnnnnnnnnnnnnnnnnnnnnnnnnnnnnnnnnnnnnnnnnnnn

SEQ ID NO: 829 - DNA, 1131 bp, Artificial Sequence
  Description of Artificial Sequence: Synthetic polynucleotide
  modified_base (1)..(912): a, c, t, g, unknown or other
  modified_base (984)..(984): a, c, t, g, unknown or other
  modified_base (994)..(996): a, c, t, g, unknown or other
  modified_base (1126)..(1131): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcctattggcagctcctcaactggcaagggccagcaagcaccttgatccactgccggcattttcatanttgaatttannnagaacaagctgttttgcatgtgatgaacttctgtcaacaaaagcatacaaatgtaaaaattgtgaggcaaaattttgcattgaatgtgacattctacttcacgaatcgctgcaagtctgtccaagttgtnnnnnn

SEQ ID NO: 830 - DNA, 558 bp, Artificial Sequence
  Description of Artificial Sequence: Synthetic polynucleotide
  modified_base (1)..(84): a, c, t, g, unknown or other
  modified_base (166)..(174): a, c, t, g, unknown or other
  modified_base (213)..(213): a, c, t, g, unknown or other
  modified_base (292)..(558): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnaatttcagagacattctccctttgtttacgcagccagttcttgtcgattcattatgcgagttcattgccgacaagtacaggnnnnnnnnnggaaaagtggatttgattgcaggattggaggcacgagantttctcttcggtccgattgtggcgtgcaaattgcgagtgccctttgtgccaatcaggaagagagggaagctgcctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 831 - DNA, 1455 bp, Artificial Sequence
  Description of Artificial Sequence: Synthetic polynucleotide
  modified_base (1)..(9): a, c, t, g, unknown or other
  modified_base (87)..(87): a, c, t, g, unknown or other
  modified_base (207)..(207): a, c, t, g, unknown or other
  modified_base (285)..(285): a, c, t, g, unknown or other
  modified_base (330)..(336): a, c, t, g, unknown or other
  modified_base (843)..(843): a, c, t, g, unknown or other
  modified_base (990)..(990): a, c, t, g, unknown or other
  modified_base (993)..(993): a, c, t, g, unknown or other
  modified_base (1024)..(1024): a, c, t, g, unknown or other
  modified_base (1071)..(1071): a, c, t, g, unknown or other
  modified_base (1074)..(1074): a, c, t, g, unknown or other
  modified_base (1116)..(1116): a, c, t, g, unknown or other
  modified_base (1143)..(1143): a, c, t, g, unknown or other
  modified_base (1167)..(1167): a, c, t, g, unknown or other
  modified_base (1176)..(1176): a, c, t, g, unknown or other
  modified_base (1197)..(1197): a, c, t, g, unknown or other
  modified_base (1209)..(1209): a, c, t, g, unknown or other
  modified_base (1428)..(1428): a, c, t, g, unknown or other
  modified_base (1453)..(1455): a, c, t, g, unknown or other
nnnnnnnnngccgacattgccgtcattgggctggccgtgatgggccagaacctcatcctgaacatgaacgaccacggatttgtggtntgtgcctttaacagaaccgtgcaaaaggtgacggattttctcgagaacgaagcgaaaggcacgaaaattgtgggcgcgaaatccatggaggagatggtcaggttgctaaaacgccctcgncgcgtgatgatgctggtgaaggcgggcagcgcagtgcaggacatgatcgacaagctggtcccactgcttgaacagggngacatcatcattgatgggggcaacagtgaataccacgactctaannnnnnngcccaagagctggcagccaagggaatccactttgtcggttgcggtgtcagcggaggcgaggagggcgcccgatttgggccatccctgatgccgggcggcgcaccagcagcatggccccacttgaagcccattttccaggggatcgcggcaagagcggacggagagccgtgctgtgaatgggttggcgaggccggttccggccactttgtgaagatggtccacaatgggatcgagtacggcgacatgcagctgatctgcgaagccttccacctgatgagccaaggccttgggctgggctatgatcagatggcggcggttttcgaagagtggaacaagggcgagctcgactcattcctcatcgagatcaccgccaacatcctgcgcttccgcgatgacgacggcaagccgatggtgccgaaaatactcgactctgcgcaacagaaaggcaccggcaaatggacaggcattgctgcacttgagtacggagttcccgtcacgctgatcccngaagccgtgtttgcccgctgcctgtccgcattgaagccccaacgtgtggccgcggcaaaagtgttgcccgggccgtccaagaaggtggagcagttggtgaaggacaagcgtgcctttttggatcacattggccaggccctctacgcntcnaaggtggtcagctacgcgcagggcttcatgntgttggccgaggccagtgcccaattcgactggaaactcgactttggngcnattgcgatgatgtggcgcggcgggtgcatcattcgctcgcgnttcttgggccgcatcaaggaggcgttnaagaagaacccgaaactggtgaanctgctgttngacgacttcttcctggatgcnatcaagaatgcncaggaatcctggcgcgaagtgatctccaccgctgtccaactcggcatcccaatgcccgccttcagcgcagcactggcattctatgatggctatcgcacggaggtgctgcccgccaattttttccaggcccaacgcgactacttcggcgcccactgctatgaactgctcgccaaaccgggctcctcggtgcacaccaactggactggcaaaggcggccgngtcacctcaaacgcctactccgcannn

SEQ ID NO: 832 - DNA, 330 bp, Artificial Sequence
  Description of Artificial Sequence: Synthetic polynucleotide
  modified_base (1)..(30): a, c, t, g, unknown or other
  modified_base (249)..(249): a, c, t, g, unknown or other
  modified_base (328)..(330): a, c, t, g, unknown or other
nnnnnnnnnnnnnnnnnnnnnnnnnnnnnngatgcattcgaacaacccgaggaggagcagggctctcgccaaggtttctgccacatccgaatccaaccagcaccccgcggggagcacgtcacaattgttcagggaattgacccgtcctatgacctgaaatggcttctgccccaattggtgaagaaacaccgctgcggtggaacagttgttgaacaccccgagtatgggaaagttatccaactgccagcngaccaacggcaggacgtcaaggacttcctctgcaaagtgggcattgtgaaggaggagaactgcaaaatccatggtttcnnn

SEQ ID NO: 833 - DNA, 1206 bp, Artificial Sequence
  Description of Artificial Sequence: Synthetic polynucleotide
  modified_base (1)..(660): a, c, t, g, unknown or other
  modified_base (714)..(714): a, c, t, g, unknown or other
  modified_base (730)..(730): a, c, t, g, unknown or other
  modified_base (788)..(789): a, c, t, g, unknown or other
  modified_base (813)..(813): a, c, t, g, unknown or other
  modified_base (847)..(847): a, c, t, g, unknown or other
  modified_base (849)..(849): a, c, t, g, unknown or other
  modified_base (858)..(858): a, c, t, g, unknown or other
  modified_base (885)..(885): a, c, t, g, unknown or other
  modified_base (894)..(894): a, c, t, g, unknown or other
  modified_base (900)..(900): a, c, t, g, unknown or other
  modified_base (903)..(903): a, c, t, g, unknown or other
  modified_base (909)..(912): a, c, t, g, unknown or other
  modified_base (916)..(917): a, c, t, g, unknown or other
  modified_base (921)..(922): a, c, t, g, unknown or other
  modified_base (925)..(933): a, c, t, g, unknown or other
  modified_base (935)..(935): a, c, t, g, unknown or other
  modified_base (937)..(939): a, c, t, g, unknown or other
  modified_base (945)..(945): a, c, t, g, unknown or other
  modified_base (957)..(957): a, c, t, g, unknown or other
  modified_base (969)..(969): a, c, t, g, unknown or other
  modified_base (981)..(981): a, c, t, g, unknown or other
  modified_base (993)..(993): a, c, t, g, unknown or other
  modified_base (996)..(996): a, c, t, g, unknown or other
  modified_base (999)..(999): a, c, t, g, unknown or other
  modified_base (1002)..(1002): a, c, t, g, unknown or other
  modified_base (1023)..(1023): a, c, t, g, unknown or other
  modified_base (1050)..(1050): a, c, t, g, unknown or other
  modified_base (1071)..(1071): a, c, t, g, unknown or other
  modified_base (1084)..(1206): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtcctacgagggcggtttcggcggagagccgggctgcgaggcgcacggcggntacaacttctgcgctntggccggcctggcgctgatgggcaaaacccacttggtgaatgtggacgccgcactccnntggtccgtctacaggcaaatgcgnatggagggcggattccagggccgcaccaacaagntngtggatgtntgctactcctactggcaagccgcctgnttttccgcnctggantgncaaatnnnnaatnnaaannggnnnnnnnnncngnnncttttngacgtttccgcnctgcaatcctangtgctggaggcntgccaatgcgcnggnggnggnttcagggacaaaccggacaancaccccgacatgtaccacacttgctangcactctcggggctggcaatngcgcaattctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 834 - DNA, 1485 bp, Artificial Sequence; identical to SEQ ID NO: 213
  Description of Artificial Sequence: Synthetic polynucleotide
  modified_base (1)..(435): a, c, t, g, unknown or other
  modified_base (1233)..(1233): a, c, t, g, unknown or other
  modified_base (1456)..(1485): a, c, t, g, unknown or other

SEQ ID NO: 835 - DNA, 2358 bp, Artificial Sequence
  Description of Artificial Sequence: Synthetic polynucleotide
  modified_base (1)..(798): a, c, t, g, unknown or other
  modified_base (940)..(1068): a, c, t, g, unknown or other
  modified_base (1323)..(1323): a, c, t, g, unknown or other
  modified_base (1380)..(1380): a, c, t, g, unknown or other
  modified_base (1389)..(1389): a, c, t, g, unknown or other
  modified_base (1392)..(1392): a, c, t, g, unknown or other
  modified_base (1429)..(1429): a, c, t, g, unknown or other
  modified_base (1479)..(1479): a, c, t, g, unknown or other
  modified_base (1492)..(1492): a, c, t, g, unknown or other
  modified_base (1494)..(1494): a, c, t, g, unknown or other
  modified_base (1518)..(1518): a, c, t, g, unknown or other
  modified_base (1534)..(1536): a, c, t, g, unknown or other
  modified_base (1599)..(1599): a, c, t, g, unknown or other
  modified_base (1618)..(1619): a, c, t, g, unknown or other
  modified_base (1623)..(1623): a, c, t, g, unknown or other
  modified_base (1631)..(1632): a, c, t, g, unknown or other
  modified_base (1635)..(1635): a, c, t, g, unknown or other
  modified_base (1659)..(1659): a, c, t, g, unknown or other
  modified_base (1680)..(1680): a, c, t, g, unknown or other
  modified_base (1683)..(1683): a, c, t, g, unknown or other
  modified_base (1745)..(1746): a, c, t, g, unknown or other
  modified_base (1750)..(1752): a, c, t, g, unknown or other
  modified_base (1785)..(1785): a, c, t, g, unknown or other
  modified_base (1995)..(1995): a, c, t, g, unknown or other
  modified_base (2247)..(2247): a, c, t, g, unknown or other
  modified_base (2253)..(2253): a, c, t, g, unknown or other
  modified_base (2263)..(2358): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcggctctattcgtgtatctggatatttgcgaggaactccattgaatgtgaacagtctagtgcatattccaggctatggtgatttccagttagaacggattgagattggacatgatccatatccattcaaagggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaaggtgaaaaacgtgtaccgaaaggaacttcggagtatcaagcaagttggttaattgatgatgaggaaggaaaggaggcggatagtgacgaaagtgatggggcaagtggcgatgaaatggatggaagcgacaaacaacaagaacaaatggaggaagaagatgaagcgaatgaaaatgattttgacaacaacgaagaagcaatgagtatttctggcatggatgcagcattggatgagtctcaaatgaaacgnttccgagaagagcgcgaaaattgccaatggccggatgaggtggaagcaccacggggnatgaatgcnagngagcgatttcaacgttatcgcggactcaaaagtttcnggacaagtccatgggatccgaaagagaatcttcctccagaatacgcaagnatttacaaaattntnaacttcaaaagaaccaaaaaactngcacttgccaagattnnngaagaagcatttgaagcggaggactttgaggaatacgcatttcccggagcgtatgtcactttncacgtgaaaaatgttcctnntcanttatgcanntcnctccgcacggatgcaccattagtngtttttgggctgcttatgcangancacaggatgagcgtcttgaacatggtccttcaaaagcacccatcttgcacagagccagtgannaacnnnagaaaagacaaactgcttttccaagttggctgncgacgttttaccgcaaacccaatattttcacaacatacaaacgggaataaattcaagatggaacgatttatgccaacttctggtgcattttgtgccaccacatttgcgcccatcatctttccaccagtgaacgttgcggtgttccgacaaaattcggcagatgcattggaattggttgcgcatggcattgttttggattcaaatccggancggattgtcttgaaacgtgccgttctttccggccatccttgcaaagtcaacaagcgatccgctgttgttcgttacatgttcttcaatagaagggatattgaatggttcaagccagtcgagctgtacactcataatggtcgtcatgggcggatcaagcaagctttgggcacacatggcctcatgaaatgcagctttgaccagcctttgaatgtgcaagattctgtgctgatgaacctttacaagcgcgtgttncccaantggacttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 836 - DNA, 897 bp, Artificial Sequence
  Description of Artificial Sequence: Synthetic polynucleotide
  modified_base (1)..(66): a, c, t, g, unknown or other
  modified_base (132)..(132): a, c, t, g, unknown or other
  modified_base (427)..(430): a, c, t, g, unknown or other
  modified_base (456)..(456): a, c, t, g, unknown or other
  modified_base (473)..(473): a, c, t, g, unknown or other
  modified_base (489)..(490): a, c, t, g, unknown or other
  modified_base (505)..(505): a, c, t, g, unknown or other
  modified_base (515)..(515): a, c, t, g, unknown or other
  modified_base (518)..(518): a, c, t, g, unknown or other
  modified_base (574)..(600): a, c, t, g, unknown or other
  modified_base (606)..(606): a, c, t, g, unknown or other
  modified_base (633)..(633): a, c, t, g, unknown or other
  modified_base (688)..(688): a, c, t, g, unknown or other
  modified_base (699)..(699): a, c, t, g, unknown or other
  modified_base (777)..(777): a, c, t, g, unknown or other
  modified_base (789)..(789): a, c, t, g, unknown or other
  modified_base (792)..(792): a, c, t, g, unknown or other
  modified_base (794)..(794): a, c, t, g, unknown or other
  modified_base (873)..(873): a, c, t, g, unknown or other
  modified_base (889)..(897): a, c, t, g, unknown or other
nnnnnnnnnnnnnnnnnnnnnnnnnnnnnnnnnnnnnnnnnnnnnnnnnnnnnnnnnnnnnnnnnnaggcaaacattggctgcacgatttcgagcgctctttctcctcagaagtgcaaaggacaatctttcngttgaatggatcagcaaatgttttattgacacatccgaactgctgaagcatgaattggcctactgtctcggtcaaatgcaaaatccaacagccattcaccatttgataaaggtcctagaagacgaaaaacaagatcccatggtcagacacgaagcaggcgaagcactcgctgcaattggggatcaaaatcttaaagagattctggaacgctttatcgacgaccctgtaaaggaagttgccgagacatgccaactggccctccaaatgatagaatggaaaaaggagaatcgacaannnncaaataaaatctacgattctatagtnccaacaccggctgcaantgatgggaatatggannaattgggagaaattntaattgatcnaanccaagttttatttattcgattaacatcattctcttatcttcaatttttagacactnnnnnnnnnnnnnnnnnnnnnnnnnnnggtctnttctgcgaagacagtgcccttttccgncatgaaattgcatatgttctgggacagatccagtcaccaatagccattcccgaantgtcgaatcgnctttatctggcttccgaaaatgctatggtcagacatgaatgcgccgaagcactcggctccatcgcaaacgaagaatgncaacaaatattnaangnttttttgcatgacacagagcgcgttgtacgagagagttgcgaagttgccttggatatcgcagaaataaacaataagccnggattatgacatgctnnnnnnnnn

SEQ ID NO: 837 - DNA, 1335 bp, Artificial Sequence
  Description of Artificial Sequence: Synthetic polynucleotide
  modified_base (1)..(27): a, c, t, g, unknown or other
  modified_base (331)..(1335): a, c, t, g, unknown or other
nnnnnnnnnnnnnnnnnnnnnnnnnnngttaaggttggacaatgcggcaaccagctgggcatggctttttgggagcgtctttgtgtggagcatggcatcacacccgatggggaagttgtacgagaggcaaagacgaatgattgcaaggagattttcttcaacgaggcgaatggccaaaaatgggtgccccgagccgtgatggtggatttggagccgcgggtgctgaacgaaatttgcaactacgaccagtactcggaccttttcgacgtggacaacatctaccaaggaccaactggcggaggcgccgggaacaagtttgttaattcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 838 - DNA, 546 bp, Artificial Sequence
  Description of Artificial Sequence: Synthetic polynucleotide
  modified_base (1)..(24): a, c, t, g, unknown or other
  modified_base (160)..(165): a, c, t, g, unknown or other
  modified_base (423)..(423): a, c, t, g, unknown or other
  modified_base (529)..(546): a, c, t, g, unknown or other
nnnnnnnnnnnnnnnnnnnnnnnntcagaggacgaattggcctccgactcatacccaatgcaactcgttgatgacctcatctacgagttcaaaggacgccaagttgtgcgcaaagagggtgaaatcgctttggatggcgcaaacccgtcggccgaggagnnnnnncaggacgaaggcactgatgagcatgttgaacgagggattgactttgtgctaaaccatcgacttcaagagatgaattgctatgaggatcaatccacattcaaaggctacatcaaggacttcatgaagaaagtggtggagtatatgcaaaaggagggcaaatccgccgaacaaattgacacattcaagaagaagatccaagcttgggttgttgggctgctcaacaaggaacgcttcaagaatttggcattcttcattgtngagaatatggccgaggggaagggcgaaggccaagttgccattgttgagtatcgccaggagggtggagaagaagtcccaaccttgatgctcatcaaagaaggtttgnnnnnnnnnnnnnnnnnn

SEQ ID NO: 839 - DNA, 327 bp, Artificial Sequence
  Description of Artificial Sequence: Synthetic polynucleotide
  modified_base (1)..(15): a, c, t, g, unknown or other
  modified_base (21)..(21): a, c, t, g, unknown or other
  modified_base (45)..(45): a, c, t, g, unknown or other
  modified_base (67)..(68): a, c, t, g, unknown or other
  modified_base (75)..(75): a, c, t, g, unknown or other
  modified_base (87)..(87): a, c, t, g, unknown or other
  modified_base (277)..(327): a, c, t, g, unknown or other
nnnnnnnnnnnnnnngatctngagaatttacataaattgagtccngaagagcgcgagaagaaagtcnncttactncgccagcaggcngctgttgcttcactgcagaatttgattgcggaaatcagcgagaagtgcaccacaaagtgcataacaagccctgggacatcgcttggcagcggcgagaagcagtgcctacaacgatgcatggatttgtttttcgagagcaacaacattgtttcgcacgctctgatgggccgaattcgacaacaagcagccnnnnnnnnnnnnnnnnnnnnnnnnnnnnnnnnnnnnnnnnnnnnnnnnnnn

SEQ ID NO: 840 - DNA, 273 bp, Artificial Sequence
  Description of Artificial Sequence: Synthetic polynucleotide
  modified_base (1)..(27): a, c, t, g, unknown or other
  modified_base (39)..(39): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (57)..(57): a, c, t, g, unknown or other
  modified_base (75)..(75): a, c, t, g, unknown or other
  modified_base (93)..(93): a, c, t, g, unknown or other
  modified_base (108)..(108): a, c, t, g, unknown or other
  modified_base (128)..(128): a, c, t, g, unknown or other
  modified_base (141)..(141): a, c, t, g, unknown or other
  modified_base (184)..(273): a, c, t, g, unknown or other
nnnnnnnnnnnnnnnnnnnnnnnnnnnttgcgtgatttnttgctncantacaangcngtcacggaggagtgcttnaatgcctgtgttgtgaanttcacaagccgggangtcagtgagaaggaggaganttgcaccaaaaantgcatgaacaaagtcctcaaggttattttgagattaaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 841 - DNA, 744 bp, Artificial Sequence
  Description of Artificial Sequence: Synthetic polynucleotide
  modified_base (132)..(132): a, c, t, g, unknown or other
  modified_base (210)..(210): a, c, t, g, unknown or other
  modified_base (240)..(240): a, c, t, g, unknown or other
  modified_base (279)..(279): a, c, t, g, unknown or other
  modified_base (291)..(291): a, c, t, g, unknown or other
  modified_base (300)..(300): a, c, t, g, unknown or other
  modified_base (330)..(330): a, c, t, g, unknown or other
  modified_base (388)..(388): a, c, t, g, unknown or other
  modified_base (402)..(402): a, c, t, g, unknown or other
  modified_base (408)..(408): a, c, t, g, unknown or other
  modified_base (436)..(436): a, c, t, g, unknown or other
  modified_base (462)..(462): a, c, t, g, unknown or other
  modified_base (510)..(510): a, c, t, g, unknown or other
  modified_base (513)..(513): a, c, t, g, unknown or other
  modified_base (528)..(528): a, c, t, g, unknown or other
  modified_base (558)..(558): a, c, t, g, unknown or other
  modified_base (582)..(582): a, c, t, g, unknown or other
  modified_base (626)..(626): a, c, t, g, unknown or other
  modified_base (628)..(629): a, c, t, g, unknown or other
  modified_base (631)..(631): a, c, t, g, unknown or other
  modified_base (633)..(634): a, c, t, g, unknown or other
  modified_base (636)..(637): a, c, t, g, unknown or other
  modified_base (639)..(639): a, c, t, g, unknown or other
  modified_base (642)..(642): a, c, t, g, unknown or other
  modified_base (681)..(681): a, c, t, g, unknown or other
  modified_base (742)..(744): a, c, t, g, unknown or other
atggcgagaaaattctttgtcggcggaaactggaaaatgaacggcacgttctccttggtcaatgaactggttgcgatgctcaacaatagcggtggaaataatgctgtccaaattgtggttgctcctccagcnccgtatttgcaccacgtcgttcagaacgtcaaaaacggagtccaagtcgcagcgcagaactgttacaaggttgcaaanggcgcattcacgggtgaaatcagtccgganatgatcaaggacgtgggcgcgacttgcgttatcctgggncattcagaacgncgccatgtntttggcgagaacgacacactcattgctganaaggctgcgcatgcacttgattccggattactggtcatctactgcattggcgagaagntggaagagcgtgangccaancaaaccaaggaagttaatttccgtcaantggaagccctgctctcgaagaacctnaactgggagaacattgtgatcgcctacgagccagtttgggccattggnacnggcaaaaccgcatcnccagagcaggcggaggaagttcacaaatgnattcgcgaatttctcgagcagaangtgtcggccgatgttgcccaatcagttcgcattatttacggagntnnantnncnncnganaactgtgttgagctggcaaagaagccgaatgtcgatgtnttcctggtgggtggcgcatcgctgaagcctgactttgtcaagattttcaacgcaaacaacnnn

SEQ ID NO: 842 - DNA, 2178 bp, Artificial Sequence
  Description of Artificial Sequence: Synthetic polynucleotide
  modified_base (1)..(159): a, c, t, g, unknown or other
  modified_base (268)..(268): a, c, t, g, unknown or other
  modified_base (326)..(326): a, c, t, g, unknown or other
  modified_base (331)..(332): a, c, t, g, unknown or other
  modified_base (334)..(334): a, c, t, g, unknown or other
  modified_base (369)..(374): a, c, t, g, unknown or other
  modified_base (394)..(394): a, c, t, g, unknown or other
  modified_base (410)..(411): a, c, t, g, unknown or other
  modified_base (436)..(437): a, c, t, g, unknown or other
  modified_base (666)..(666): a, c, t, g, unknown or other
  modified_base (750)..(750): a, c, t, g, unknown or other
  modified_base (789)..(789): a, c, t, g, unknown or other
  modified_base (949)..(949): a, c, t, g, unknown or other
  modified_base (966)..(966): a, c, t, g, unknown or other
  modified_base (1191)..(1191): a, c, t, g, unknown or other
  modified_base (1419)..(1419): a, c, t, g, unknown or other
  modified_base (1435)..(1435): a, c, t, g, unknown or other
  modified_base (1497)..(1497): a, c, t, g, unknown or other
  modified_base (1848)..(1848): a, c, t, g, unknown or other
  modified_base (1956)..(1956): a, c, t, g, unknown or other
  modified_base (2052)..(2052): a, c, t, g, unknown or other
  modified_base (2092)..(2178): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattcattgagaagcgcattcaactctttgaccaactgatgagggcctacaaagagcaagtcgcagcaaaagcagcagagccaatcaaagtgaagctgccagaaaacnaattggatgatgccttcgcttgggtgacaacgccgctctccattgcagaaaaagttanaaaanngntgctcgaccgcttggtgattgccaaagtcaatggnnnnnnctgggatttggaccgaccantggaggcggattcccnnctggagttgctcacattcgatgacnncgaaggcaagcaagtcttctggcacagctcggcccacattcttggcgaggcttgcgagcgctactgcggctgccacctctgctatgggccgccaattcaggagggattctattacgacatgcacattgaggggaaaacaataaaccccgaggatttcaccaaactggaggccatcattggcacaattgtgaaggagcggcagccctttgagcggcttgaaatgagcaangaggatttgctccgcatgttcgactacaatccgttcaagcagcgcattatcaaagagaaggtgcagacgcccacaacaacagtntatcggtgtggaccgctgattattttgtgccgaggcccncatgtgcaaaccacgggcaaaattaaggcgattgcggtcacgaaggcatcctcctcctattgggaaggcaaagttgacaacgagcagctgcaacgagtgtatggcatttccttccccgacccgaaacaactgaaacaatggcgagtgctacaagaggagncagccagacgggaccancgcaagttggggcgtgaccaggaactcttcatgttcaacccaatgtcgccgggatcggctttctggtacccaaaaggcgctcacatctacaacaccatggtcaacttcattcgcacggagtacaggaagcgtggctttcaagaggtgatcacgccgaacatctacaatgcaaagttgtgggaacagtcgggccactggcatcattatgcggacaacatgttcganttcgaagttgagaaggaacaatttgcgttgaagccaatgaactgcccgggccattgcctgatgtttgaccacaagccgcgttcctacaatgagctgcccattcggtttgccgactttggtgtgctgcatcggaatgaactgagcggcgcactgactggcctcacacgcgttcgccgcttccaacaagacgatgcccacatcttctgccgcagcgatcagctcacacangagattctggcctgcntggacttcctcaacttcgtctacattgatgtgttcggattttccttcaaactgttcctcagnacacgtccagaaggctatcttggcgatttggaaagctggaacttggccgaaagtcagctgaaggaggcgttggatgccagcgggcacaaatgggagttgaatcccggggatggagcattctatgggccaaagattgacattcaaatcaaggacgccttgggccgctactggcaatgcgcaacactgcaacttgacttccagctgcctcaacgctttgacttgcactatttcgacgagaacaaagagcgccatcgccccgtgatcatccaccgcgccatttttggctccctcgagcgcatgattgcaattctaacggaaaacttcgctggcaaatggcccttctggttgtcnccgcgccaagcaaagatcatcgttgtgcacaagtccgtcaaggagtacgcggcctctgtccgtgagcgcattttccgggccggctttgaggtggaatttgacgagganagtccggacacgctgaacaagcggatcaggaatgcccagctggagcagttcaacttcattctggtcattggccaagtggagcagacgaatgggacngtgaatgtgcgcacacgggacaatcaggtttggggaaaannnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 843 - DNA, 921 bp, Artificial Sequence
  Description of Artificial Sequence: Synthetic polynucleotide
  modified_base (108)..(108): a, c, t, g, unknown or other
  modified_base (241)..(243): a, c, t, g, unknown or other
  modified_base (262)..(263): a, c, t, g, unknown or other
  modified_base (454)..(543): a, c, t, g, unknown or other
  modified_base (712)..(786): a, c, t, g, unknown or other
  modified_base (919)..(921): a, c, t, g, unknown or other
atgagctcatcggttgtgtgcccttcgcatccggacgcgcacttgattgaggaccacagggccggcgatttgatttgcacccagtgtggactggttgtgggggaacgnttgatcgatgtgggcacggagtggcgctcgttcagtgacgaacggtccgggaatgatccgtcgcgtgttggcgcacccgagaacccgttgttgtccagctccgatctgtccaccagcattgccgtctcgtttnnnggctcggacagtgggcgcnntctggcgaacgcccagcgcaagctgaccaacaacaacgaccgccaaatgacgcaggcgctgatgcaaatccgggagatgagcgagaagatcaacctggcgcgtcccatccaggaccgggcggccaagcgcttcaaggaggtgctcgagtccaaggcgttgcgtggcaagagcaacgaggcacaggttgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgctgtttccgcctgatcaccaaaacgctggagaccaacctggagctgatcaccagcgccgacttcatgtctcgattctgcggctacctgaacctgcctttccccgtgcaaaccgccgcaactcgcattgcaaagaaggctgttgagatggacttggtggccgggnnnnnnnnnnnnnnnnnnnnnnnnnnnnnnnnnnnnnnnnnnnnnnnnnnnnnnnnnnnnnnnnnnnnnnnnnnngagattggcgagatcgccggcgttgcggaggacacaatccgcctgacctatcgcctgctactgcccaaggcgttggagctgttcccggccgagttccgctttgacacgcccgtcgatcagttgccccgcgctnnn

SEQ ID NO: 844 - DNA, 579 bp, Artificial Sequence; identical to SEQ ID NO: 306
  Description of Artificial Sequence: Synthetic polynucleotide
  modified_base (442)..(579): a, c, t, g, unknown or other

SEQ ID NO: 845 - DNA, 501 bp, Artificial Sequence; identical to SEQ ID NO: 303
  Description of Artificial Sequence: Synthetic polynucleotide
  modified_base (105)..(105): a, c, t, g, unknown or other
  modified_base (228)..(228): a, c, t, g, unknown or other
  modified_base (309)..(309): a, c, t, g, unknown or other
  modified_base (496)..(501): a, c, t, g, unknown or other

SEQ ID NO: 846 - DNA, 222 bp, Artificial Sequence
  Description of Artificial Sequence: Synthetic polynucleotide
  modified_base (123)..(123): a, c, t, g, unknown or other
  modified_base (127)..(127): a, c, t, g, unknown or other
  modified_base (135)..(135): a, c, t, g, unknown or other
  modified_base (142)..(142): a, c, t, g, unknown or other
  modified_base (144)..(146): a, c, t, g, unknown or other
  modified_base (149)..(149): a, c, t, g, unknown or other
  modified_base (192)..(192): a, c, t, g, unknown or other
atgattgagatcacggtgaacgaccgactgggcaaaaaggtgcggatcaagtgcaatcccacggacacaattggcgacctgaagaagctggtggctgcccagactggaacaagagccgacaanctgntgctgaanaagtggnannncanctacaaggaccacatcacactgcaggactacgagatccatgangggttcaactttgagctgtactaccaatga

SEQ ID NO: 847 - DNA, 1029 bp, Artificial Sequence
  Description of Artificial Sequence: Synthetic polynucleotide
  modified_base (1)..(39): a, c, t, g, unknown or other
  modified_base (313)..(354): a, c, t, g, unknown or other
  modified_base (610)..(1029): a, c, t, g, unknown or other
nnnnnnnnnnnnnnnnnnnnnnnnnnnnnnnnnnnnnnnatgggcgaaacggcctcagcattctcggtccaattgcgctgcttttctgcgccattctttggcaaatatgacacagagaagatcaacgaactcaactatggtggcaagatacttctacccaactcatgccttgacaaccttattcgtcgccatatccaatggcccatgctgttcaaattgaccaatatcgagcaccagaaatcaactcatgcgggagtgttggaatttctagccgaagagggaaagtgctatctgccttcatgggttttgaaannnnnnnnnnnnnnnnnnnnnnnnnnnnnnnnnnnnnnnnnnagttcgcttccgccagccacctatgcaaagttcaagcccatgtccaccgatttctatcacgtcaccaatccaaaggccatgttggaggttgaattgcgaaaattttcctgtcttaccaaaaatgacgtgattgcggtccagtataatgagcaagtctttgaattcaaagttatggagttgaagcctcagaatgcggtgacaatcattgaatgcgacattaacattgaatttgatgctgccgagggttatgttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 848 - DNA, 1269 bp, Artificial Sequence
  Description of Artificial Sequence: Synthetic polynucleotide
  modified_base (1)..(42): a, c, t, g, unknown or other
  modified_base (178)..(178): a, c, t, g, unknown or other
  modified_base (180)..(180): a, c, t, g, unknown or other
  modified_base (186)..(187): a, c, t, g, unknown or other
  modified_base (189)..(192): a, c, t, g, unknown or other
  modified_base (197)..(200): a, c, t, g, unknown or other
  modified_base (294)..(294): a, c, t, g, unknown or other
  modified_base (297)..(297): a, c, t, g, unknown or other
  modified_base (330)..(330): a, c, t, g, unknown or other
  modified_base (363)..(363): a, c, t, g, unknown or other
  modified_base (369)..(369): a, c, t, g, unknown or other
  modified_base (373)..(375): a, c, t, g, unknown or other
  modified_base (378)..(378): a, c, t, g, unknown or other
  modified_base (382)..(384): a, c, t, g, unknown or other
  modified_base (387)..(387): a, c, t, g, unknown or other
  modified_base (391)..(391): a, c, t, g, unknown or other
  modified_base (394)..(395): a, c, t, g, unknown or other
  modified_base (405)..(405): a, c, t, g, unknown or other
  modified_base (408)..(408): a, c, t, g, unknown or other
  modified_base (415)..(416): a, c, t, g, unknown or other
  modified_base (418)..(418): a, c, t, g, unknown or other
  modified_base (421)..(421): a, c, t, g, unknown or other
  modified_base (423)..(423): a, c, t, g, unknown or other
  modified_base (426)..(426): a, c, t, g, unknown or other
  modified_base (430)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (453)..(453): a, c, t, g, unknown or other
  modified_base (465)..(465): a, c, t, g, unknown or other
  modified_base (468)..(468): a, c, t, g, unknown or other
  modified_base (471)..(471): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (525)..(525): a, c, t, g, unknown or other
  modified_base (531)..(532): a, c, t, g, unknown or other
  modified_base (534)..(534): a, c, t, g, unknown or other
  modified_base (540)..(541): a, c, t, g, unknown or other
  modified_base (543)..(543): a, c, t, g, unknown or other
  modified_base (550)..(550): a, c, t, g, unknown or other
  modified_base (555)..(555): a, c, t, g, unknown or other
  modified_base (559)..(561): a, c, t, g, unknown or other
  modified_base (565)..(565): a, c, t, g, unknown or other
  modified_base (567)..(567): a, c, t, g, unknown or other
  modified_base (569)..(570): a, c, t, g, unknown or other
  modified_base (573)..(573): a, c, t, g, unknown or other
  modified_base (576)..(576): a, c, t, g, unknown or other
  modified_base (579)..(580): a, c, t, g, unknown or other
  modified_base (588)..(589): a, c, t, g, unknown or other
  modified_base (592)..(593): a, c, t, g, unknown or other
  modified_base (600)..(600): a, c, t, g, unknown or other
  modified_base (603)..(604): a, c, t, g, unknown or other
  modified_base (609)..(610): a, c, t, g, unknown or other
  modified_base (630)..(631): a, c, t, g, unknown or other
  modified_base (633)..(633): a, c, t, g, unknown or other
  modified_base (636)..(636): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (653)..(654): a, c, t, g, unknown or other
  modified_base (658)..(658): a, c, t, g, unknown or other
  modified_base (661)..(665): a, c, t, g, unknown or other
  modified_base (672)..(673): a, c, t, g, unknown or other
  modified_base (675)..(675): a, c, t, g, unknown or other
  modified_base (678)..(679): a, c, t, g, unknown or other
  modified_base (681)..(681): a, c, t, g, unknown or other
  modified_base (684)..(684): a, c, t, g, unknown or other
  modified_base (687)..(687): a, c, t, g, unknown or other
  modified_base (690)..(690): a, c, t, g, unknown or other
  modified_base (702)..(703): a, c, t, g, unknown or other
  modified_base (1047)..(1047): a, c, t, g, unknown or other
  modified_base (1264)..(1269): a, c, t, g, unknown or other
nnnnnnnnnnnnnnnnnnnnnnnnnnnnnnnnnnnnnnnnnngtgatcatgtcgcgcaactaccgaggcgacatcgacgtcggttgcattgaaaagttcatgccgctgctgatggagcaggaggacgagggccgaacatcgccaatcattcagaagggcgaacacagttacatctacntnaagcanntnnnnatttnnnnggtagctttggccaaaaagaacccaaatgttgcaatggtgctctcgttcctgtacaaatgcgtggaaaccttcatttgctacttcaaggatttngangaggagtcggttcgggacaattttgtggttatntacgagttgttggatgaaatgcttgattttggntatccncaannnacngagnnncgnattntgnnagagtacatnacncaagagnncnacnanctngagnnnnnnccncgnccnccaatggcngtcaccaatgcngtntcntggcgttccganggcatcaantancgnaanaatgangttttnctngatgtcatngagtcnntnaatttnntngcaaatnccaanggcnnngtgntncnnagnganatnnttggctcnntcnnaatgcgngtnntcctnnctggaatgcccgaactccgnntnggnctcaangacaangtncnntttnagnnnnntggaaanngncgnngnaangcngtngagttggagganntcaaattccatcaatgcgttcgtctgtcgagatttgaaaatgaccgcaccatcagcttcatcccgcccgatggcgaattcgagttgatgaactaccggttgagcacagtggtgaagccgttgatttgggtggaaacgtccatggagaagtacgcccattcgcgcattgagtacattgtcaaggcaaaatcccaattcaagcgccaatccatcgccaaccatgtggaaatccacgtgcccgtccagaatgatgcggactcgcccaagttcaagtccattgtgggttctgcccgttatgcacccgaggaaggcgcattcatttggaccatccgaagctttccaganggccgtgagtacttgatgcgcgcccatttcagcctaccctcggtggaaggcgaagaattggactcaaaacggccaatcagtgtgaagttcgaaatcccctatttcaccacctctggattgcaagttcgctacctgaagatcatcgagaagagcggctaccaagcattgccctgggttcgttacgtcacccagaatggcgactatttcattcgagtgnnnnnn

SEQ ID NO: 849 - DNA, 1470 bp, Artificial Sequence
  Description of Artificial Sequence: Synthetic polynucleotide
  modified_base (30)..(30): a, c, t, g, unknown or other
  modified_base (364)..(726): a, c, t, g, unknown or other
  modified_base (1243)..(1249): a, c, t, g, unknown or other
  modified_base (1251)..(1252): a, c, t, g, unknown or other
  modified_base (1254)..(1254): a, c, t, g, unknown or other
  modified_base (1275)..(1275): a, c, t, g, unknown or other
  modified_base (1350)..(1350): a, c, t, g, unknown or other
  modified_base (1359)..(1359): a, c, t, g, unknown or other
  modified_base (1387)..(1470): a, c, t, g, unknown or other
atgcccaaaataaatgttaaattcggctcnaagactctcagtgtggacgccgatttgaatgagccgccgtttctgttgaaagcacaactttttgagctgaccgaagttccacctgagcgtcaaaagcttctcatcaagggaaaaaccattggcaatgattcgtggaatgggattgctctcaaggatggggcaacaatcatgttgctcggaaacactggctcaactgaagcctcatccacgggaaatgcagagagcggcggatcatcaacaaaaccggtgaaacaggacgaagttgtgctgcccgttggactcaagaatttgggcaacacttgctacatgaatgcgactctgcaatgttttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcagttgaattgctacctgagccaggaggtccgctacatccagtccggcatcaaaaacaaaatgaaagaggagatctccaagttctcaaccgcactcaaatgtgaggccctctatgagaagcattcccagatcagccgcttgcctgcctatctgtccgtccaaattgtgcgcttttactacaaggagaaggaaaatgttaacgcgaaaattctgaaagacgtcaaattcccgcttgtccttgatgttttcaagttgtgcaccccggagttccaagagaagctgaaaccggcgcgccaagcactcaaggattacgacgacgccaaggtggaattgcagcgaaaggcaaagctggccaatccggacgatcccaaaatggacttgaagccgaaggggtatttgcccaacactttcgaggaagaccctggctctaacaacagtgggatctatgaacttaaggctctcatcacacacaaaggccgtgccagcaacgccggccactatgtcgcctgggttnnnnnnncnnanagtgccaaatgggcggcttgngacgatgacgacatttatccggtcacggaggaggagatcctgaagctgtcgggtggaggcgactggcattgtgcntacgtgctnctctacgggcccaagaagatcccacaannnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 850 - DNA, 774 bp, Artificial Sequence
  Description of Artificial Sequence: Synthetic polynucleotide
  modified_base (48)..(48): a, c, t, g, unknown or other
  modified_base (57)..(57): a, c, t, g, unknown or other
  modified_base (72)..(72): a, c, t, g, unknown or other
  modified_base (87)..(87): a, c, t, g, unknown or other
  modified_base (166)..(198): a, c, t, g, unknown or other
  modified_base (288)..(288): a, c, t, g, unknown or other
  modified_base (315)..(315): a, c, t, g, unknown or other
  modified_base (412)..(412): a, c, t, g, unknown or other
  modified_base (486)..(486): a, c, t, g, unknown or other
  modified_base (570)..(570): a, c, t, g, unknown or other
  modified_base (658)..(774): a, c, t, g, unknown or other
atgtctggaggaggaaaagatcggattgcggtgttcccgtctcgggtngcccagacngtaatgaaaactcgnctgaagggtgcccanaaagggcacagtttgctgaagaaaaaggcggacgcattgaacttgcgctttcgggaaatcctcaagaaaataactgagnnnnnnnnnnnnnnnnnnnnnnnnnnnnnnnnngcggccttttctttggcggaagcaaaattcacggccggcgatttctcgccacacgttatccagaacgtatcccaagcacaatacaccgtncgtatgaagaaggacaatgtcgtggtngtttttctgcccgtgttcgaagcgcaccgatcggacggtgatgcgtacaatctgactggtttggggaagggcggcgccaacattgccaagctgaagnagaactacaaccgtgccgtcgagttgttggtggagttggccactctgcaaacctgcttcataaccctggatgangccatcaaaatcacaaaccgccgtgtgaatgccatcgagcacgtgatcatcccaaagatcgagaacactctgacctacatttgnaccgaattggacgaaatggagcgcgaggagttcttccgcatgaagaaaatccaggccaaaaagaagcgcgaccgagacgcccaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 851 - DNA, 645 bp, Artificial Sequence
  Description of Artificial Sequence: Synthetic polynucleotide
  modified_base (1)..(78): a, c, t, g, unknown or other
  modified_base (81)..(81): a, c, t, g, unknown or other
  modified_base (127)..(127): a, c, t, g, unknown or other
  modified_base (132)..(132): a, c, t, g, unknown or other
  modified_base (165)..(165): a, c, t, g, unknown or other
  modified_base (207)..(207): a, c, t, g, unknown or other
  modified_base (348)..(348): a, c, t, g, unknown or other
  modified_base (401)..(402): a, c, t, g, unknown or other
  modified_base (405)..(412): a, c, t, g, unknown or other
  modified_base (414)..(422): a, c, t, g, unknown or other
  modified_base (424)..(431): a, c, t, g, unknown or other
  modified_base (492)..(492): a, c, t, g, unknown or other
  modified_base (631)..(645): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnntantacatgatcaccggccaaggagaccgcttcgatgttgcctggttcntgacngaaacaccaccccatatgtgggcaggcattggnattgctgcctcactttccctgtctgtcatcggcgctggaggnggaattttcacgactggctcatccattttgggcggtggtgtgaaagcgcccaggattcggacaaagaacctggtgtctatcattttctgtgaagccgtcgccatttttggcatcatcatggcgtttgtttttgccggaaanctttggcgtaagcaattctttatgttaattgaaaataaagatggaattctagnnatnnnnnnnnannnnnnnnncnnnnnnnnaatctttggaggcggccttaccgttggcttcagcaatttggtttgcggccttgcagtggcngttgttggatccggcgcagctttggcggacgcagcaaacccagctttattcgtcaaaatcctgattattgaaatttttgccagcgccattggactctttgggatgatcattgggattgttcaggtttttaagcattctnnnnnnnnnnnnnnn

SEQ ID NO: 852 - DNA, 681 bp, Artificial Sequence
  Description of Artificial Sequence: Synthetic polynucleotide
  modified_base (70)..(70): a, c, t, g, unknown or other
  modified_base (345)..(345): a, c, t, g, unknown or other
  modified_base (630)..(630): a, c, t, g, unknown or other
  modified_base (679)..(681): a, c, t, g, unknown or other
atgggcatctcggacaatgacgtgcaaaagcagttgcgccacatgatggccttcattgagcaggaggcgntggagaaagcggaggagattgacgccaaagcggaggaggagttcaacatggaaaagggccgtctggtgcaacagcaacgccagaagatcatggagtactacgagaagaaggagaagcaggttgagttgcagcggaaaattcagcgctcaaacatgcaaaaccacggccgcctgcaatgcctgaaagcgcaggacgagcatgtgaagcaggtgctggacgaggcgcgggccaatctgtccaaaatttcggccgacactcaccgctatccggccatnctgaagggactcatcatgcagggccttttccaactgctcgagaaggaggtggtgctgcgttgccgctcccaggatgagcaactggtgaagcagctgctgccggaatgtttggaggagttgcagaagacttggggcaacacaaccaaggtctccatcgacaacacgccccccctgcccaaggacgcggccggcggtgtggaaatgtccgctcgggatggccgaatccgggtccgctccacgctggagtcccgtctggacctgatcgccgagcaaatcgtcccacanattcgcaccgcactgtttgggccgaacccgaatcgcaaattctttgacnnn

SEQ ID NO: 853 - DNA, 366 bp, Artificial Sequence
  Description of Artificial Sequence: Synthetic polynucleotide
  modified_base (84)..(84): a, c, t, g, unknown or other
  modified_base (111)..(111): a, c, t, g, unknown or other
  modified_base (120)..(120): a, c, t, g, unknown or other
  modified_base (163)..(164): a, c, t, g, unknown or other
  modified_base (327)..(327): a, c, t, g, unknown or other
  modified_base (364)..(366): a, c, t, g, unknown or other
atggcatttgcacaaaaaggcaaattgatggcagtgatcggagatgaggacactgttgttggctttttgctcggaggaatagcncaactcaacaaggctcgtaagccgaanttcctgatngtggacaagaacacaagcgtgacggacattgaggaagcattcnnttctttctgcacccgcgatgacattgcgatcatattgataaaccagcacgttgccgaaatgatccgctaccaggttgaccaacatgtggccagcatccccaccgtcctggaaatcccatcaaaggagatgccttatgacgcctcaaaagacagcattttgaancgggcaagaggtttgatcaatccagaggacttaaaannn

SEQ ID NO: 854 - DNA, 1644 bp, Artificial Sequence
  Description of Artificial Sequence: Synthetic polynucleotide
  modified_base (1)..(93): a, c, t, g, unknown or other
  modified_base (294)..(294): a, c, t, g, unknown or other
  modified_base (535)..(633): a, c, t, g, unknown or other
  modified_base (745)..(798): a, c, t, g, unknown or other
  modified_base (951)..(951): a, c, t, g, unknown or other
  modified_base (999)..(999): a, c, t, g, unknown or other
  modified_base (1008)..(1008): a, c, t, g, unknown or other
  modified_base (1035)..(1035): a, c, t, g, unknown or other
  modified_base (1137)..(1137): a, c, t, g, unknown or other
  modified_base (1331)..(1331): a, c, t, g, unknown or other
  modified_base (1443)..(1443): a, c, t, g, unknown or other
  modified_base (1549)..(1644): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaagcataatttcttgcgcccatgcgcaaagtgaaatgatgcagaaggaagtttacttgtttgaacgtttggactctggcacaattcgggagcaaatcaaattcctcaaatgtatagcattcatcaggccaaccccagaaaacgtgcaattgctgtccgaagagcttcgttaccccaaatatgcccaatattacattatnttttcgaatataatctccaaagccgacctaaaaacattggcagagtcggatgagcaagagacggtcagagaagtgcgagaattttatgtcgattccatcccgctttcatcgcattttgctacattaaacattccttccccgtacgcttcacaattcaacctttccactgtggttttccgacgctgcctgcaagcgctgaccgcaatttgtcttgcgttgaacaaaaaaccaacaatcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttaactttttattccaaaaattaggatccaatttcgccattgctgaatcaatggacttacgaggcgatggtgcatgaattgattgggatcaacaacaatcgcgtcactnnnnnnnnnnnnnnnnnnnnnnnnnnnnnnnnnnnnnnnnnnnnnnnnnnnnnnaatatgtactcaaattttggcgacattgggcagaacatcaagagtttgatgaatgattaccaaaggaaggcaaaaacacattctcaattggaatccattggcgatatgaagaaatttgttgaacaatatccacaattcaagaagatttcaggnactgtgtccaaacatgttcaattggtgggcgaattgagtcggctggtnaccgatggnaaccttttggaaatttctgagcttgancagaacattgtggccaatggtgatcaccaagcatgcattgattctttgcgaaaacttcttcaaaatccgaagaccaatgatctcaatgcccttcgtttggcnatgctttacgcacttcgctttgagaacagcagcagcaattccctgaacactgtgctggacttattgcgtcagcgtgcaaatcgccatattcaactgatccgaacattgctggactatgccgggttgaggcgaagacaaaacgatgtttttgggaatagatcggccatggaaatgacaaaacggtttataaaagntctgaaaggtgttgagaacatttacacccaacacgagccctacattacccaattgatcgactgggtttccaaggggaagctgcccgaaacgaaattcccctcaaccgacttngcccgcttcgatgatgttatcatcttcataattggcggtgccacctttgaagagagtgcagccgtggccaacataaacgcacggagagcatcagctttgagtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 855 - DNA, 1368 bp, Artificial Sequence
  Description of Artificial Sequence: Synthetic polynucleotide
  modified_base (1)..(36): a, c, t, g, unknown or other
  modified_base (256)..(259): a, c, t, g, unknown or other
  modified_base (261)..(261): a, c, t, g, unknown or other
  modified_base (263)..(266): a, c, t, g, unknown or other
  modified_base (269)..(272): a, c, t, g, unknown or other
  modified_base (274)..(277): a, c, t, g, unknown or other
  modified_base (279)..(280): a, c, t, g, unknown or other
  modified_base (283)..(284): a, c, t, g, unknown or other
  modified_base (286)..(289): a, c, t, g, unknown or other
  modified_base (291)..(292): a, c, t, g, unknown or other
  modified_base (294)..(294): a, c, t, g, unknown or other
  modified_base (296)..(300): a, c, t, g, unknown or other
  modified_base (302)..(306): a, c, t, g, unknown or other
  modified_base (308)..(308): a, c, t, g, unknown or other
  modified_base (310)..(310): a, c, t, g, unknown or other
  modified_base (312)..(312): a, c, t, g, unknown or other
  modified_base (315)..(316): a, c, t, g, unknown or other
  modified_base (318)..(320): a, c, t, g, unknown or other
  modified_base (322)..(330): a, c, t, g, unknown or other
  modified_base (332)..(335): a, c, t, g, unknown or other
  modified_base (340)..(345): a, c, t, g, unknown or other
  modified_base (347)..(351): a, c, t, g, unknown or other
  modified_base (353)..(356): a, c, t, g, unknown or other
  modified_base (360)..(360): a, c, t, g, unknown or other
  modified_base (366)..(366): a, c, t, g, unknown or other
  modified_base (372)..(372): a, c, t, g, unknown or other
  modified_base (375)..(376): a, c, t, g, unknown or other
  modified_base (378)..(378): a, c, t, g, unknown or other
  modified_base (381)..(385): a, c, t, g, unknown or other
  modified_base (388)..(392): a, c, t, g, unknown or other
  modified_base (394)..(394): a, c, t, g, unknown or other
  modified_base (396)..(397): a, c, t, g, unknown or other
  modified_base (399)..(400): a, c, t, g, unknown or other
  modified_base (402)..(402): a, c, t, g, unknown or other
  modified_base (407)..(410): a, c, t, g, unknown or other
  modified_base (412)..(413): a, c, t, g, unknown or other
  modified_base (417)..(419): a, c, t, g, unknown or other
  modified_base (421)..(421): a, c, t, g, unknown or other
  modified_base (423)..(429): a, c, t, g, unknown or other
  modified_base (431)..(437): a, c, t, g, unknown or other
  modified_base (441)..(447): a, c, t, g, unknown or other
  modified_base (449)..(450): a, c, t, g, unknown or other
  modified_base (453)..(453): a, c, t, g, unknown or other
  modified_base (455)..(458): a, c, t, g, unknown or other
  modified_base (460)..(465): a, c, t, g, unknown or other
  modified_base (469)..(472): a, c, t, g, unknown or other
  modified_base (475)..(476): a, c, t, g, unknown or other
  modified_base (478)..(486): a, c, t, g, unknown or other
  modified_base (674)..(674): a, c, t, g, unknown or other
  modified_base (678)..(678): a, c, t, g, unknown or other
  modified_base (937)..(937): a, c, t, g, unknown or other
  modified_base (996)..(996): a, c, t, g, unknown or other
  modified_base (1011)..(1011): a, c, t, g, unknown or other
  modified_base (1014)..(1014): a, c, t, g, unknown or other
  modified_base (1282)..(1284): a, c, t, g, unknown or other
  modified_base (1330)..(1368): a, c, t, g, unknown or other
nnnnnnnnnnnnnnnnnnnnnnnnnnnnnnnnnnnngcgaaaaatgatgaaattgaggccccgattgaaattgaatcgctttgtccgggctgccatgagaatggaataacaaaactgatctcactgaacatcccgttctatcgtcaagtcattgtcatgtccttctcatgcgaacattgcggccaccggaacagcaatttgcaatcgggcgaacaagcacaggaattcggcacggacgcggtctcaaagtgaagannnncnannnnctnnnncnnnnanntgnncnnnncnnanannnnntnnnnnanantnccnnannngnnnnnnnnntnnnncccannnnnncnnnnngnnnncttnaccacngttganggnntnctnnnnnccnnnnngnannanntncaacnnnngnngccnnngngnnnnnnngnnnnnnnggannnnnnnannaantnnnngnnnnnnttgnnnnganngnnnnnnnnnattcgactggaaaagccatatgttcagaaactgcatgacccatccggcaactgcttcatccaaaaccccagcccattccatgtcgacccaaactgcatagccagccactactgccggccgcttgaggaggacaaactgctcgggctggtggacgacaatgcggtggagcagttgagtcaggatgagcnggcngagagggagtggaaatcctacgaggatgtcaagaatgaggtcctccgctttccgggcacttgccaggcttgtggggcgccatgtgagacgaggatgaagccaacagacattccctacttccaaacggtgatcataatgtccacggattgtgaccgctgtgggttcaagtcgaatgatgtcaagagtggcggtgccatccaatcaaatgggtgccggttgagtgtgcgcgttgaggagccaattgacttggcccgtgacntgctcaagtcggacacctgctcaatcacaattcccgagctggacattgagttgagcccnggcattctgtccggncgnttcaccacagtcgagggcatgctgaccgccacccgggaccaactccaacggcaggcgccattcttcctgggcgacagtgcgctggaggaggaccggaggaagttccaggagaagttggaccgactggatgcggccattcgactggaaaagccatgcaccctggtgctggatgatccggctgggaacagttacattcagagcttggcagcccctctggacgatggccgtctccaaaaggagttctacccgcgcacatttgagcagaatnnngagcttggactgaacgacatgcgggtggagaactatgaggaactgnnnnnnnnnnnnnnnnnnnnnnnnnnnnnnnnnnnnnnn

SEQ ID NO: 856 - DNA, 1422 bp, Artificial Sequence
  Description of Artificial Sequence: Synthetic polynucleotide
  modified_base (1)..(327): a, c, t, g, unknown or other
  modified_base (358)..(358): a, c, t, g, unknown or other
  modified_base (363)..(363): a, c, t, g, unknown or other
  modified_base (368)..(369): a, c, t, g, unknown or other
  modified_base (373)..(375): a, c, t, g, unknown or other
  modified_base (381)..(382): a, c, t, g, unknown or other
  modified_base (385)..(385): a, c, t, g, unknown or other
  modified_base (388)..(390): a, c, t, g, unknown or other
  modified_base (399)..(402): a, c, t, g, unknown or other
  modified_base (404)..(404): a, c, t, g, unknown or other
  modified_base (408)..(417): a, c, t, g, unknown or other
  modified_base (421)..(423): a, c, t, g, unknown or other
  modified_base (430)..(432): a, c, t, g, unknown or other
  modified_base (438)..(447): a, c, t, g, unknown or other
  modified_base (450)..(452): a, c, t, g, unknown or other
  modified_base (454)..(457): a, c, t, g, unknown or other
  modified_base (462)..(462): a, c, t, g, unknown or other
  modified_base (466)..(466): a, c, t, g, unknown or other
  modified_base (468)..(469): a, c, t, g, unknown or other
  modified_base (472)..(472): a, c, t, g, unknown or other
  modified_base (474)..(475): a, c, t, g, unknown or other
  modified_base (477)..(478): a, c, t, g, unknown or other
  modified_base (480)..(482): a, c, t, g, unknown or other
  modified_base (486)..(486): a, c, t, g, unknown or other
  modified_base (488)..(488): a, c, t, g, unknown or other
  modified_base (494)..(495): a, c, t, g, unknown or other
  modified_base (497)..(502): a, c, t, g, unknown or other
  modified_base (504)..(506): a, c, t, g, unknown or other
  modified_base (511)..(511): a, c, t, g, unknown or other
  modified_base (513)..(513): a, c, t, g, unknown or other
  modified_base (526)..(621): a, c, t, g, unknown or other
  modified_base (892)..(930): a, c, t, g, unknown or other
  modified_base (976)..(978): a, c, t, g, unknown or other
  modified_base (1098)..(1098): a, c, t, g, unknown or other
  modified_base (1276)..(1276): a, c, t, g, unknown or other
  modified_base (1278)..(1279): a, c, t, g, unknown or other
  modified_base (1284)..(1284): a, c, t, g, unknown or other
  modified_base (1420)..(1422): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtccaattctcgccggacacccgaacanttgcntccgnntccnnngacaannccntcnnnctctgggannnncnaacnnnnnnnnnnctgnnnaccctgnnnggccannnnnnnnnngtnnncnnnnttgcntggncnncgnanngnngnnngctngnttcggnntnnnnnnannncacantnaaggtttgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcttttggcaagcgccggccgcgacgcaaccatccgaatttgggacactgtcacctatggaacactgcgagtgctgagcgggcacacagcttcggtgactgcgctttgctggggcggcaatgggctgatttattcgggctctcaggaccgcactgtgaaagtgtggcgtgccgcggatggcgtcctgtgccgcaacctgactggccatgcccactggataaacacgctggcgctgaatgtggactatgtgctccgggttggcttctacnnnnnnnnnnnnnnnnnnnnnnnnnnnnnnnnnnnnnnncaggcccaacaagcagccaaaaagcgctacgagcgcgcactgaacnnnagtcagcccgagcgccttgtttcgggttctgatgatttcacgatgtacctttgggaaccggccgacaaaaagcagccaattgcccgaatgaccggccatcagcagttgattaatcaggtncaattctcgccggacacccgaacaattgcatccgcctcctttgacaagtccatcaagctctgggacggccgaaccggcaaattcctgtccaccctgcgcggccacgtttcgcccgtctaccaaattgcatggtcggcggacagcagactgcttgtttcgggctctgccgattccacantnnaggtntggaacatccaaaagagtcgactggcgctggatctgcccggccatggggatgaagtgttcgcagtggactggagcccctccggagagcatgttgcaagcggaggaaaggacaaattgttgaagctttggaaacgannn

SEQ ID NO: 857 - DNA, 780 bp, Artificial Sequence
  Description of Artificial Sequence: Synthetic polynucleotide
  modified_base (1)..(3): a, c, t, g, unknown or other
  modified_base (30)..(30): a, c, t, g, unknown or other
  modified_base (70)..(70): a, c, t, g, unknown or other
  modified_base (72)..(72): a, c, t, g, unknown or other
  modified_base (84)..(84): a, c, t, g, unknown or other
  modified_base (87)..(87): a, c, t, g, unknown or other
  modified_base (112)..(112): a, c, t, g, unknown or other
  modified_base (114)..(114): a, c, t, g, unknown or other
  modified_base (129)..(129): a, c, t, g, unknown or other
  modified_base (135)..(135): a, c, t, g, unknown or other
  modified_base (162)..(162): a, c, t, g, unknown or other
  modified_base (204)..(204): a, c, t, g, unknown or other
  modified_base (246)..(246): a, c, t, g, unknown or other
  modified_base (258)..(258): a, c, t, g, unknown or other
  modified_base (276)..(276): a, c, t, g, unknown or other
  modified_base (288)..(288): a, c, t, g, unknown or other
  modified_base (290)..(290): a, c, t, g, unknown or other
  modified_base (372)..(372): a, c, t, g, unknown or other
  modified_base (402)..(402): a, c, t, g, unknown or other
  modified_base (429)..(429): a, c, t, g, unknown or other
  modified_base (432)..(432): a, c, t, g, unknown or other
  modified_base (438)..(438): a, c, t, g, unknown or other
  modified_base (459)..(459): a, c, t, g, unknown or other
  modified_base (477)..(477): a, c, t, g, unknown or other
  modified_base (507)..(507): a, c, t, g, unknown or other
  modified_base (522)..(522): a, c, t, g, unknown or other
  modified_base (528)..(528): a, c, t, g, unknown or other
  modified_base (530)..(531): a, c, t, g, unknown or other
  modified_base (536)..(536): a, c, t, g, unknown or other
  modified_base (778)..(780): a, c, t, g, unknown or other
nnnccacaaaacgagcatatagaattgcancggaaacgttatggacgacggttggaccatgaagagaggngncgtaagaagctngcnagagcagttcatgaacgctctaaantngctaagaaactgcgnaagggnaaggccaaactttaccacaaaaagcgntattccgaaaaggttcaaatgcgcaaattgatcaaacaacangaggagaagaaacagaagaacactgttgatgagcccacgganggagcagttccnacctatttgttggacagncaacaacaaacnantgggaaggcattgagcgatgctatcaagcagaaacgcaaagaaaaagctgctaaattccaagttccactaccaaaagtcaangctgttagtgatgcagaagcattcaaagtngtgcagacaggcaaaactcgcagaaanggntggaancgaatggttaccaaagtgacntttgtgggcgagactttnacaaggaagccggctaaatttgaacgcttnatacgtccaatgggncttcgntnnaaaanggcacacgtaacacaccctgaattgaagaccactttctgcctgcccattgttggcgtcaagaagaatccctcgtcacaattgtacacatcgctgggagtcatcaccaaaggaacaattattgaagtgaatgtcagcgaacttggaatggtgacccaaggaggaaaagtggtttgggctaaatatgcacaagtgacgaaccatccggaaaatgatggctgcataaatgcggtcttgttggttnnn

SEQ ID NO: 858 - DNA, 1035 bp, Artificial Sequence
  Description of Artificial Sequence: Synthetic polynucleotide
  modified_base (1)..(117): a, c, t, g, unknown or other
  modified_base (130)..(130): a, c, t, g, unknown or other
  modified_base (132)..(133): a, c, t, g, unknown or other
  modified_base (135)..(136): a, c, t, g, unknown or other
  modified_base (138)..(138): a, c, t, g, unknown or other
  modified_base (153)..(153): a, c, t, g, unknown or other
  modified_base (158)..(158): a, c, t, g, unknown or other
  modified_base (163)..(163): a, c, t, g, unknown or other
  modified_base (219)..(219): a, c, t, g, unknown or other
  modified_base (225)..(225): a, c, t, g, unknown or other
  modified_base (237)..(237): a, c, t, g, unknown or other
  modified_base (264)..(264): a, c, t, g, unknown or other
  modified_base (273)..(279): a, c, t, g, unknown or other
  modified_base (282)..(285): a, c, t, g, unknown or other
  modified_base (287)..(287): a, c, t, g, unknown or other
  modified_base (290)..(291): a, c, t, g, unknown or other
  modified_base (294)..(299): a, c, t, g, unknown or other
  modified_base (301)..(306): a, c, t, g, unknown or other
  modified_base (308)..(311): a, c, t, g, unknown or other
  modified_base (316)..(321): a, c, t, g, unknown or other
  modified_base (333)..(333): a, c, t, g, unknown or other
  modified_base (363)..(363): a, c, t, g, unknown or other
  modified_base (370)..(370): a, c, t, g, unknown or other
  modified_base (373)..(373): a, c, t, g, unknown or other
  modified_base (396)..(396): a, c, t, g, unknown or other
  modified_base (402)..(402): a, c, t, g, unknown or other
  modified_base (419)..(419): a, c, t, g, unknown or other
  modified_base (421)..(421): a, c, t, g, unknown or other
  modified_base (426)..(426): a, c, t, g, unknown or other
  modified_base (429)..(429): a, c, t, g, unknown or other
  modified_base (442)..(443): a, c, t, g, unknown or other
  modified_base (450)..(450): a, c, t, g, unknown or other
  modified_base (469)..(469): a, c, t, g, unknown or other
  modified_base (481)..(482): a, c, t, g, unknown or other
  modified_base (489)..(489): a, c, t, g, unknown or other
  modified_base (492)..(492): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (531)..(531): a, c, t, g, unknown or other
  modified_base (546)..(546): a, c, t, g, unknown or other
  modified_base (553)..(555): a, c, t, g, unknown or other
  modified_base (560)..(560): a, c, t, g, unknown or other
  modified_base (567)..(567): a, c, t, g, unknown or other
  modified_base (574)..(575): a, c, t, g, unknown or other
  modified_base (578)..(579): a, c, t, g, unknown or other
  modified_base (581)..(581): a, c, t, g, unknown or other
  modified_base (588)..(588): a, c, t, g, unknown or other
  modified_base (594)..(594): a, c, t, g, unknown or other
  modified_base (598)..(599): a, c, t, g, unknown or other
  modified_base (604)..(607): a, c, t, g, unknown or other
  modified_base (609)..(615): a, c, t, g, unknown or other
  modified_base (623)..(626): a, c, t, g, unknown or other
  modified_base (628)..(630): a, c, t, g, unknown or other
  modified_base (652)..(652): a, c, t, g, unknown or other
  modified_base (658)..(659): a, c, t, g, unknown or other
  modified_base (666)..(666): a, c, t, g, unknown or other
  modified_base (669)..(670): a, c, t, g, unknown or other
  modified_base (672)..(674): a, c, t, g, unknown or other
  modified_base (676)..(678): a, c, t, g, unknown or other
  modified_base (684)..(685): a, c, t, g, unknown or other
  modified_base (691)..(691): a, c, t, g, unknown or other
  modified_base (708)..(713): a, c, t, g, unknown or other
  modified_base (715)..(715): a, c, t, g, unknown or other
  modified_base (717)..(718): a, c, t, g, unknown or other
  modified_base (723)..(723): a, c, t, g, unknown or other
  modified_base (863)..(863): a, c, t, g, unknown or other
  modified_base (880)..(1035): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgacgcgattnanncnnancaagtgctggtccgntggcnggcgncgcccatcaatccggcggacatcaaccaaatccaaggagtatacgcgattaaaccnaaactnccagcggttggnggcaatgagggctgtggagtggtgganaaggttggnnnnnnngtnnnncnatnnaannnnnncnnnnnngnnnncccgnnnnnngcgggcggtggnatttggacagaatttgcatttgttccgcangaggcantgntgaaggtggattcgagcattganttggcntcggctgccacactcgncntgaanccnccaaccgcctatnnaatgctnaaggattttgtgccactgncggccggcgatnnggtcatncanaatggggcgaattcnggngttggccgctangttattcangtttgccgaatcttnggctttnnnacaancaacatngttcgcnncannancgagatngaaganttgnnaaacnnnntnnnnnnncttggcgnnnngnnngtgttcacgcaggaggaattcnccaatnncaccaanaanntnnnannngccaanntggcantgaattgtgtgggcggnnnnnncngnntgctncttgtgcgcgcattggcgcccggcggtgtgcacgtcacctacgggggaatgtcccaacaacccgttcaagtgcccaccactgcgctcattttcggcgatgtccgggtgtgcggattttgggtgtcccgctggtatgagcngaacagtggggccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 859 - DNA, 2916 bp, Artificial Sequence
  Description of Artificial Sequence: Synthetic polynucleotide
  modified_base (1)..(3): a, c, t, g, unknown or other
  modified_base (99)..(99): a, c, t, g, unknown or other
  modified_base (495)..(495): a, c, t, g, unknown or other
  modified_base (576)..(576): a, c, t, g, unknown or other
  modified_base (1315)..(1315): a, c, t, g, unknown or other
  modified_base (1507)..(1509): a, c, t, g, unknown or other
  modified_base (1722)..(1722): a, c, t, g, unknown or other
  modified_base (1807)..(1812): a, c, t, g, unknown or other
  modified_base (1948)..(2031): a, c, t, g, unknown or other
  modified_base (2383)..(2383): a, c, t, g, unknown or other
  modified_base (2400)..(2400): a, c, t, g, unknown or other
  modified_base (2412)..(2412): a, c, t, g, unknown or other
  modified_base (2467)..(2467): a, c, t, g, unknown or other
  modified_base (2487)..(2487): a, c, t, g, unknown or other
  modified_base (2490)..(2490): a, c, t, g, unknown or other
  modified_base (2505)..(2505): a, c, t, g, unknown or other
  modified_base (2523)..(2523): a, c, t, g, unknown or other
  modified_base (2550)..(2550): a, c, t, g, unknown or other
  modified_base (2691)..(2691): a, c, t, g, unknown or other
  modified_base (2694)..(2694): a, c, t, g, unknown or other
  modified_base (2863)..(2916): a, c, t, g, unknown or other
nnntcttctggagaccaaccctgctattcattgatttatgtgtcaaatgacattgagtttccttccgaaggacaattaaaggaaaaattcgaacatgtngatacaaaggccaaaactgaagcactgaaaaagttgattattatgatacaggctggagaaaaggttagccagagtctgatgatgtatgtaatccgcttttgcttgccaacaactgaccattatctgaaaaaattgctacttcatttctgggaagttgtgccgaagaccaaccaagatggtaaattgctacaagaaatgattcttgtttgtgacgcataccggaaggacttgcttcatccgaacgaatatatccgtggttctacgcttcgcttcttatgcaaattacgtgaacccgaactattagagcccttgatgccttcaattctcaaatgtctcgaacatcgacattcctatgttcgcaggaatgccatcttagcaattttcacaatttacagnaattttgaatttcttgttccaaatgcacccgaagtcatttttcaacttttggagtctgaacaggatgcatcatgtaaaggnaatgcctttattatgctgctccatgtagatcaacaacgagcacttgagtatttatctggctgcattgaccaagtccaacattttggagacattcttcaacttgtcattgttgagcttatttacaaggtttgtcataatgatccagccgagcgaaatcgcttcattcgctgtgtttacaatctgcttcaatcccaatcggctgccgttcgttatgaagcagccggaacattggtgacattgagttcagcaccagcagcagtgaaagccgcggctacagcgtacattgacctgattgtgaaggaatcggacaataatgtcaaactgattgtcttggatcgcttggttggactccgcgaagttcttcccaatgacaaggttcttcaagagctggttatggacattcttcgtgttctctcaacaaccgactatgaagtgcgcaagaaaatattgcaactcacgctggaacttatttcttcccgaaatgtgcatgaaatggtcatgttcttgaagaaggaaatcgacaaaaccaacaatgaccagcaggaagacactggtcgatacaggcaattgttggtacgcactctgcacagtgcaaccatcaaattcccggatgtggcccaacaaatatttcctgtactcatggaattcctttcggatcaaagtgaaacggctgcaatggatgttcttgttttcattcgcgaagcaatccaacgcctaccccatttgcgccaccatattntggaacaattattggaagttttcccaaccattcggaatgcctcaattttccgttctgcactctggattttaggcgaatatagccaatccgagacaatttgccgcgtattcgaactggtgaaggactctttgggtgaattgccaattgtggagatggaaacaatggaacgtgagggcgaaggagccaaagaannnacgacaaagaaggatgcgaaacccaagcaattgatcactgccgatggcacttacgcgacacaaaccgcggtttattcaaccgcaaatcagaattccaacaatgataagccaatattccgtaaacttctacttgaggggaatttctttatcgcttcttctgctgccaatgatttggcaaaacttgtgcttcgttattcggaattaaacaaagtngttcaaaccactgtgaataaacttgctggacaagcaatgctgctaatatccaacattatccatttgggcaaatctggattatgtnnnnnnaagcaaccggtcactgaagatgacttggatcgtctctcaaccaccctcaaactgattgttgacaattggccggatgcagttcctggattcttggaggagtgccgactttcattggaacaaatgttgcaagcaaagnnnnnnnnnnnnnnnnnnnnnnnnnnnnnnnnnnnnnnnnnnnnnnnnnnnnnnnnnnnnnnnnnnnnnnnnnnnnnnnnnnnngacaaaacaatcatgtttacccaattgtcgacacgtgagggagtgactggcacaaatttgtttgatctttctctctcccaagcgcttggaactgcaccaaaaccggctaaattcgattttgccacctccaagttggggaaagtgattcaattggccggcttttctgatcctgtttacgccgaggcctatgtgaatgtgaatcaatatgacattgttttggatgttttggtcgtcaatcaaaccgccgatactctgcagaatttatccttggaattgtcaacagagggcgatttaaaactggtggataaaccttctcctgtgacattggctccacatgattttaccaatatanaggctaccgtgaaagtntcttccactganaatggcgttattttctccacaattgcgtacgacgttcgtgggtccacatcggacngaaattgtgtctatttgganganattcacatagacatnatggattacattgtgccngggacctgcacggacactgaattcagnaaaatgtgggcagaatttgagtgggagaacaaggttggcgttgtcacaccaatcacggatttgcgccaatatttgaaccatttgtccgcccaaaccaacatgaaattactcacaacggatgctgcactggagggtgattgnggntttctggcagccaatttctgtgcccattccatattcggcgaagatgcactggccaatgtgagcatcgaaaaggccgatccgctggatccaaacagtgccatcattggacacattcgcatccgggcaaagtcccagggaatggcactttcgctgggtgataaggttaacnnnnnnnnnnnnnnnnnnnnnnnnnnnnnnnnnnnnnnnnnnnnnnnnnnnnnn

SEQ ID NO: 860 - DNA, 1029 bp, Artificial Sequence
  Description of Artificial Sequence: Synthetic polynucleotide
  modified_base (118)..(118): a, c, t, g, unknown or other
  modified_base (120)..(120): a, c, t, g, unknown or other
  modified_base (231)..(231): a, c, t, g, unknown or other
  modified_base (234)..(234): a, c, t, g, unknown or other
  modified_base (403)..(462): a, c, t, g, unknown or other
  modified_base (579)..(579): a, c, t, g, unknown or other
  modified_base (609)..(609): a, c, t, g, unknown or other
  modified_base (648)..(648): a, c, t, g, unknown or other
  modified_base (667)..(667): a, c, t, g, unknown or other
  modified_base (669)..(669): a, c, t, g, unknown or other
  modified_base (702)..(702): a, c, t, g, unknown or other
  modified_base (985)..(1029): a, c, t, g, unknown or other
ttatcttgtcgattttattcaaatgaatttccggatattgaggatcctgtgatggtgaaagtgcagaaaattgcagaaatgggcgcctatgtgacattgtgcgaatatgacaataaangnggcatgattctgttgtcggaactctcgcgtagacgaattcgatccgtgaacaaattggttcgagttggtcgcatggagtgtgtggttgtcatccgagtggatcaagacaangtntacatcgacttgtcaaagcgcagagtttatgccaaggacctgatcctgtgtgaagatcgttttgccaaagcaaaggctataaacagcattttgcgacatgtcggagaacaattgggttacacaaagaatgaggaattggaagaattatatgataaggtaacattcaatnnnnnnnnnnnnnnnnnnnnnnnnnnnnnnnnnnnnnnnnnnnnnnnnnnnnnnnnnnnngactccactgtctttgatgagtgcgaaattgatgcaaaagtgaaggcaaaactgctggatgagattcgcaaaaaactcacaccgaaaccgcacaaaattcgctccgacattgaagtnagctgcttctcctacgatggcatcgaggcngtcaaaaacgcattgatcattggcaaaaactgctctacngaagaaatgccaatcaagntnaatctgatcgcagctccactctttgttgtccanactcaaacaatggatcgagtcgagggaatcgatgccatccaaaaagcattggacgcaataaaggaggccattgagtcgcaccagggcactttcaaagtgatcatgccgcccaaggtattgactgatctggacgaagaggagatgaagaaacgattggaacttctggaagaggaggagctgggcagttcggaggaggaaggagcggccgaagaggaaggacttgtggcaccaaagggattggaccaggcagcggatgccgaagaggcgaatcgggggaacaagnnnnnnnnnnnnnnnnnnnnnnnnnnnnnnnnnnnnnnnnnnnnn

SEQ ID NO: 861 - DNA, 1410 bp, Artificial Sequence
  Description of Artificial Sequence: Synthetic polynucleotide
  modified_base (1)..(6): a, c, t, g, unknown or other
  modified_base (307)..(324): a, c, t, g, unknown or other
  modified_base (691)..(691): a, c, t, g, unknown or other
  modified_base (693)..(694): a, c, t, g, unknown or other
  modified_base (696)..(696): a, c, t, g, unknown or other
  modified_base (856)..(1056): a, c, t, g, unknown or other
  modified_base (1062)..(1062): a, c, t, g, unknown or other
  modified_base (1071)..(1071): a, c, t, g, unknown or other
  modified_base (1092)..(1092): a, c, t, g, unknown or other
  modified_base (1281)..(1281): a, c, t, g, unknown or other
  modified_base (1293)..(1293): a, c, t, g, unknown or other
  modified_base (1393)..(1410): a, c, t, g, unknown or other
nnnnnngatgagaaggcagcggatgactcacaaccatggctgatgaagcaggacttgtccacgctggatcccgccaaacttgatccattaactgaggaagtgatcagccgtcaagccacaataaatatagaaacaattggccatgtcgcccacggcaagtccaccctggttaaggcgatttccggagtgcacaccgtgaagttcaagaacgagctggagcgcaacatcacaatcaagctgggctatgccaacgcgaaaatctatcggtgcaacaatccggactgtccgcgtccacattgctacaggnnnnnnnnnnnnnnnnnncccgaccgcattccctgtgatcgaccaaactgtgggggcgagtacgtgtgcgtgcgccatgtctcctttgtggactgtccggggcacgacattctcatggccaccatgttgaacggtgctgctgttatggacgcagccatgctgctgattgccggcaacgagccctgtccacagccccaaacctcggagcacttggccgccgtggaaatcatgaagctgaagcatttgctgatcctgcagaacaagattgacctgatcaacgagaaccaagcaaaggaccagcacgaccagatcaagaactttgtggagggcaccgtcgcagacgcggcccccatcattcccatctccgcacaactcaagtacaacntnnangtcctctgcgaatatctgtgcaaaaaggtgcccgtcccagtccgtgacttcacttcgcccgcccgtctcattgtggtccgctcctttgacgtgaacaagcccggctcggaggtggagcagctgaagggcggtgtggctgggggttccattctgaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcggncacgtgctnggtgcggtcggcacactgccngacatctacacggacattgagatttcctaccatttgctgcgccgtctgctcggggtgcgcacggaggcgggcaaaaagggcgcaaaagtggcgaaactgaccaagggcgaggtgctgatggtcaacattgggtcgctctccaccggtggacgcgtgattgccgttaaaggtgaagccgccaaaatcacnctgaccgacccnatctgcacggaggacaaccagaacattgcgctcagccgccgcatcgagaagcattggcgcctgattggatggggcacaatccgacggggcaccaccattnnnnnnnnnnnnnnnnnn

SEQ ID NO: 862 - DNA, 1359 bp, Artificial Sequence
  Description of Artificial Sequence: Synthetic polynucleotide
  modified_base (156)..(156): a, c, t, g, unknown or other
  modified_base (252)..(252): a, c, t, g, unknown or other
  modified_base (289)..(432): a, c, t, g, unknown or other
  modified_base (486)..(486): a, c, t, g, unknown or other
  modified_base (607)..(726): a, c, t, g, unknown or other
  modified_base (768)..(768): a, c, t, g, unknown or other
  modified_base (885)..(885): a, c, t, g, unknown or other
  modified_base (1159)..(1359): a, c, t, g, unknown or other
atggatttggtcaagcgctcgaccgcaaaagcacgggaattgcgtcgcctgaacttcttcataaccgaaacttttgaattggccgaaaaacattgtgaggatgccatcaaacggggcaagcagcccttcacaatggcaatcaaggacagcttttcngtgaaggatgtgcggaaaacttgcgcctcaaagatgcttgccaattacacaccggaatatacgtccacttgcgtgcaacgccttctggacaatgcnggctgtcttgttggcaagtcgaacatggacgagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactcggaacggacacgggcggctcagtccgctatccggccgcaatcaatggnatttacgggttcaaaccgtcctacgggcgcttgtcaagacatggccttgtcccattggcaaattcactggacactccgtccatcttcacaaattccatttcgaattgccggagatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctgccgatgcccaccgcgtttgggaggccgcaattgcncaattcaaagcggatggggccacaacaatcagggaagtgcacttgccgaacatggagcacgccattgaatgctacaccatcattgtgtgcgcggatgttgcctcgaacatggcaagntatgatggcattcgatacggacataggacggaaatgaagccgactcatctggagcatataaccaccaatcgaaccgagggattctcgcaggccgtcaaaaggcgcatttttgctgggaattattttcttctacaagagaattataagcaatttgtggaacaagcggccaaagtgcggcgactgatccagcaggactaccacgaggctttcaaccaggtcgactgcattctggcgccagtcagtcgccactcggcacccatgttttccgaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 863 - DNA, 462 bp, Artificial Sequence
  Description of Artificial Sequence: Synthetic polynucleotide
  modified_base (1)..(72): a, c, t, g, unknown or other
  modified_base (210)..(210): a, c, t, g, unknown or other
  modified_base (396)..(396): a, c, t, g, unknown or other
  modified_base (448)..(462): a, c, t, g, unknown or other
nnnnnnnnnnnnnnnnnnnnnnnnnnnnnnnnnnnnnnnnnnnnnnnnnnnnnnnnnnnnnnnnnnnnnnnngcttcctatcatgagaaagtgattgaccactacgagaacccgcgcaatgttggatcgttggataagaatgatccctcagttggaaccggcgttgttggggcaccagcatgcggagatgtgatgaaacttcaaatcaangtcgatgagaatggaaagataattgatgcaaagttcaaaacctttggttgcggatcggccattgccagctcctcattggccacagaatggataaagggacgtaacttggactacgcgggcaaaatcaagaaccaagaaattgccaaggaactctcgctcccaccagtaaagctgcattgttcgtgnttggctcaagatgcgatccaagcggcattgagtgactacaagaagaagcagnnnnnnnnnnnnnnn

SEQ ID NO: 864 - DNA, 579 bp, Artificial Sequence
  Description of Artificial Sequence: Synthetic polynucleotide
  modified_base (1)..(87): a, c, t, g, unknown or other
  modified_base (202)..(327): a, c, t, g, unknown or other
  modified_base (396)..(396): a, c, t, g, unknown or other
  modified_base (529)..(531): a, c, t, g, unknown or other
  modified_base (577)..(579): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnntcagaatgcacaatgcccatcgagtactgcgagtacagcggcaaatacgacaaatgccagcagtggctggagcggaacttgcccgaactggcccaacaactccgggtggatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacgctgaaaaccgaggtgcgcagcaaaaaggcagtcaccgttgtcaaggggctcagcacatgcggnatcgagctgaaagtggcctccaaattcttttccaaccgcttcgcctgtggatgctccgtggccggtgccgacgaactcgtcattcaaggcgacttcaaggatgaactgctcgacgtgattcccgagaagtggnnnggcgtggacgaggacgtcattgaggacttgggcggagaccagaagnnn

SEQ ID NO: 865 - DNA, 492 bp, Artificial Sequence
  Description of Artificial Sequence: Synthetic polynucleotide
  modified_base (1)..(33): a, c, t, g, unknown or other
  modified_base (73)..(75): a, c, t, g, unknown or other
  modified_base (234)..(238): a, c, t, g, unknown or other
  modified_base (240)..(246): a, c, t, g, unknown or other
  modified_base (249)..(252): a, c, t, g, unknown or other
  modified_base (254)..(257): a, c, t, g, unknown or other
  modified_base (259)..(259): a, c, t, g, unknown or other
  modified_base (261)..(265): a, c, t, g, unknown or other
  modified_base (276)..(276): a, c, t, g, unknown or other
  modified_base (385)..(492): a, c, t, g, unknown or other
nnnnnnnnnnnnnnnnnnnnnnnnnnnnnnnnngacgacacacaaaatgtctcccgtggcgaaccaaccgcannngtgctggacaaggaggaatacgatgcgctttgccagcttgttaatccaattgcccagccgctcgccaaccgacgactggcaaagaaggtctacaaacttgtgaggaagtcgaccaaggagaagggctttctgcgcaatgggctcgccgatgtgatgaannnnntnnnnnnnaannnnannnncntnnnnntttttacaggnaatgtgtcgccaatcgatgtgtacagtcacattccagggatgtgtgaagaaaggggacttccttacttgttcacgccatccagggagcaattgggtttattcacaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 866 - DNA, 2025 bp, Artificial Sequence
  Description of Artificial Sequence: Synthetic polynucleotide
  modified_base (1)..(174): a, c, t, g, unknown or other
  modified_base (280)..(318): a, c, t, g, unknown or other
  modified_base (426)..(426): a, c, t, g, unknown or other
  modified_base (508)..(513): a, c, t, g, unknown or other
  modified_base (622)..(622): a, c, t, g, unknown or other
  modified_base (633)..(633): a, c, t, g, unknown or other
  modified_base (636)..(636): a, c, t, g, unknown or other
  modified_base (654)..(655): a, c, t, g, unknown or other
  modified_base (659)..(659): a, c, t, g, unknown or other
  modified_base (663)..(663): a, c, t, g, unknown or other
  modified_base (670)..(670): a, c, t, g, unknown or other
  modified_base (705)..(706): a, c, t, g, unknown or other
  modified_base (711)..(712): a, c, t, g, unknown or other
  modified_base (719)..(720): a, c, t, g, unknown or other
  modified_base (736)..(804): a, c, t, g, unknown or other
  modified_base (933)..(933): a, c, t, g, unknown or other
  modified_base (1222)..(1383): a, c, t, g, unknown or other
  modified_base (1410)..(1410): a, c, t, g, unknown or other
  modified_base (1495)..(1722): a, c, t, g, unknown or other
  modified_base (1822)..(2025): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcgcaacacaatcggcaacatcccggtccaatggtacgcggagtatggccatgttgggtacagcctgacgggcgaacgcatcccaaaagcggagggagctggtnnnnnnnnnnnnnnnnnnnnnnnnnnnnnnnnnnnnnnnttcaggcgcaaagtgttcgaccaacagaccggcgaagaggtggcactgaccgacgagcaggtgcaaaagttggaggccattgctggtagccgatacccacaaattgcntacaacccgtatgagccattctttgatttgttctcgtcccagcgggaaatccacccaatttccaatcggccgccggataaannnnnnttcatccccagcctggatgaacggcgcattgtgtcgcggatggtgcacgccatcaaaatgggctggatgaaacggcgcgaccagctcgaggaggaggcgaaagtctacnatttgtgggcngangaagacagtgagcagtcnnagancaantcggagntggcccgcctcaaaatgcattggcccgcgccaaanntgccnntgccggnncatgccgagtcgtacnnnnnnnnnnnnnnnnnnnnnnnnnnnnnnnnnnnnnnnnnnnnnnnnnnnnnnnnnnnnnnnnnnnnncgtcgcctcgacttcattccacaacgctttgatgctctccgaaaagtgccattctatgagcgcttctatgaggaacggttggagcgatgcatggacttgcatttggcgccaggcagaggagacaacggnctcaacgttgatgcaagccaattgttgccggatttgccgaatcccaaggaccttcagccattcccaacgacacttgcattttacatgcgcggccacctcggccaagtccgcggcttgtcagtggaacccgagtgcggtgaactgttggtgtctggtggtgcggattgcacggtgcgcgcatggatgttgccgagtgggtattgtttgcgccaatttcggatgccagcgccggttacttgcgtccagttttgtccggatccggcaaaaacactcgtactggttggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatccgcaatgtggcatggcaccgnaagggcgactactttgccaccgtgggtttccaacaaacagccagcactgtgctcatccaccagctcagcaaatgcaattcgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgacttcggcacaaaaccgtggaaaaagctgcgcaaccatcagtccgcaatccgcgcaatttgctaccatcgcaagtatccgctgttggccacagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 867 - DNA, 1134 bp, Artificial Sequence
  Description of Artificial Sequence: Synthetic polynucleotide
  modified_base (1)..(30): a, c, t, g, unknown or other
  modified_base (250)..(345): a, c, t, g, unknown or other
  modified_base (485)..(485): a, c, t, g, unknown or other
  modified_base (525)..(525): a, c, t, g, unknown or other
  modified_base (537)..(537): a, c, t, g, unknown or other
  modified_base (564)..(564): a, c, t, g, unknown or other
  modified_base (600)..(600): a, c, t, g, unknown or other
  modified_base (606)..(607): a, c, t, g, unknown or other
  modified_base (612)..(612): a, c, t, g, unknown or other
  modified_base (631)..(631): a, c, t, g, unknown or other
  modified_base (642)..(642): a, c, t, g, unknown or other
  modified_base (705)..(705): a, c, t, g, unknown or other
  modified_base (710)..(710): a, c, t, g, unknown or other
  modified_base (741)..(743): a, c, t, g, unknown or other
  modified_base (991)..(1134): a, c, t, g, unknown or other
nnnnnnnnnnnnnnnnnnnnnnnnnnnnnngagattaccatacaggcgcccgtcaatattgccctcatcaagtattgggggaaacgcaatgaggatttgattcttcccctgaacgactcaatatcggtggccatcgatgaattgtttgcaaccaccagggtctcaattggtccgcacattgaggaggatgttattgttgtgaacggcaaagcaattgatgtggggcattccgcacgtttccaacgagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcagattgattccaaaaccaattttccaacggctgcgggacttgcttcatccgcagctggctttgcagcaattgcctttgggttgggtcaactatttcatttgagggaggcggatattgtccgattagcaagaattgnttcaggatcagcgtgcagaagcattttgagtgggtttgtncattggaaggcnggcaattccgacgatgatttggattgngtctgcgagacaattgaacccgcctcgcattggccngaactnngcgcngtgattgttgtggtcagcnacagtgagaanaaggtgggcagcagcgaggcaatgcgcaacacaatcaaaacatcggaactgttgaaagctcgngtcancgaaattgtgccaaagagagttgaacggttnnnagaagccataagagcaaaagacttcccaaaactggccgaaatcacaatggccgagagcaaccaattgcacgcgatttgccttgacacgcagccgccaatcacttatttgaacgcaacttcccacgctttgattgagtttgtgcacgaattcaacactcatggcatccgtcttgcttacacatttgacgcgggccccaattgctgtcttttcatggaggaggaaacgcttcaccaattcatgcgcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 868 - DNA, 1362 bp, Artificial Sequence
  Description of Artificial Sequence: Synthetic polynucleotide
  modified_base (1)..(120): a, c, t, g, unknown or other
  modified_base (219)..(219): a, c, t, g, unknown or other
  modified_base (313)..(510): a, c, t, g, unknown or other
  modified_base (745)..(745): a, c, t, g, unknown or other
  modified_base (747)..(753): a, c, t, g, unknown or other
  modified_base (755)..(757): a, c, t, g, unknown or other
  modified_base (765)..(765): a, c, t, g, unknown or other
  modified_base (786)..(786): a, c, t, g, unknown or other
  modified_base (795)..(795): a, c, t, g, unknown or other
  modified_base (807)..(807): a, c, t, g, unknown or other
  modified_base (841)..(841): a, c, t, g, unknown or other
  modified_base (843)..(843): a, c, t, g, unknown or other
  modified_base (845)..(845): a, c, t, g, unknown or other
  modified_base (900)..(900): a, c, t, g, unknown or other
  modified_base (951)..(951): a, c, t, g, unknown or other
  modified_base (993)..(993): a, c, t, g, unknown or other
  modified_base (1228)..(1228): a, c, t, g, unknown or other
  modified_base (1231)..(1237): a, c, t, g, unknown or other
  modified_base (1239)..(1241): a, c, t, g, unknown or other
  modified_base (1266)..(1267): a, c, t, g, unknown or other
  modified_base (1357)..(1362): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtttacgtgcccggaatgagccgcacactgaaggagtccgaagagctggtgtacgactcaaaagcctatttgatgctgcacacattcgagactgtntttccatgcctgagttttgacattctgcccgactcattgggcgacaatcggcaaagctatccaatgactgcttggttggccagtggaacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcagtcaacacgcctgggccccagtgacatctgtgcggtgtggaatgaccaagccaaggtgcaggtgtggaacctctccccatgcatttccgccgtggaggagttggagtcgccctccaaatggcagaggatggaaaatcagcgcccattgttcacttttgccggccattccgcggaagggtttgcactggcctggtcccaacttcagacgggcactctggccagtggggatntnnnnnnnannnttttcctntggcgaatggctgagggcggncaatggctnattgatcagcgnccgctcggtgatcaccagggttctgtggaggatntngnctggtcaccaactgaagaagccctgctgatttcctgctcaaccgatcgaacattncgtctctgggacgttcgttcccccgcaaaagacgcctgtgtgtgcactgtncgagacgctcacgagtccgatgtgaatgtgatcagtgtgaanggctcggaatcgttgattctctcgggcggggatgatgccgctcttcgggtgtggtccatgaagacaattcagtacaaccaaccggtggcccaattccggcaccaccggaagccgatcacctcggtggagtggagtccccacgacaataccctgttcatggcatccggcgaagacgaccagaccaccatttgggacttggcactggaggaggacgagccaattgggcacatgaaantgnnnnnnnannngctcttcattcacatgggacaaaannaagtgaaagaggtgcactggcatggccaatgcccgggcgtggcattcagcacagcgcaggacggcttccacgtgttcaagaccatcaatnnnnnn

SEQ ID NO: 869 - DNA, 1422 bp, Artificial Sequence
  Description of Artificial Sequence: Synthetic polynucleotide
  modified_base (1)..(3): a, c, t, g, unknown or other
  modified_base (144)..(144): a, c, t, g, unknown or other
  modified_base (155)..(155): a, c, t, g, unknown or other
  modified_base (157)..(157): a, c, t, g, unknown or other
  modified_base (159)..(159): a, c, t, g, unknown or other
  modified_base (162)..(162): a, c, t, g, unknown or other
  modified_base (354)..(354): a, c, t, g, unknown or other
  modified_base (1302)..(1302): a, c, t, g, unknown or other
  modified_base (1304)..(1305): a, c, t, g, unknown or other
  modified_base (1307)..(1307): a, c, t, g, unknown or other
  modified_base (1420)..(1422): a, c, t, g, unknown or other
nnntcagtaaaatttctggaatttgtgaagccattctgcggcttcgtgcccgaggtctcaaagcccgagaggaaaattcaattccgggagaagatgctctggacggccatcacattgttcgtcttcctcgtctgttgtcaaatncccctattcgntntnatntccacagacagcgcagaccctctctattggcttcgagtgatcatggcctcgaacaggggaactctcatggaattgggcatctcgcccattgtcacatctggcttgataatgcaactcttggccggcgcaaagatcatcgaagttggggacacgccaaaggaaagggcgctcttcaatggggcacagaaaccnttcggaatggtcatcacaatcggccaggcaattgtctatgtcgcatccggaatgtacggaaatccacatgagattggcgctggcatttgcctgctcatcgtcatccaactggtcattgctggattgattgtgctgttgttggacgaattgcttcagaaaggttatggcctcggctctggcatttccctgttcattgccaccaacatttgcgaaacgatcgtctggaaagccttttcgccggccacaatgaacaccgggcgcggcactgaattcgaaggtgcaatcatcgccctcttccacctgctggccacccggaatgacaaagtgcgtgcgctgcgcgaggctttctaccgccagaacttgcccaatctgatgaacttgcttgccaccgtcctggtctttgctgtggtcatctacttccaagggttccgcgtcgacttgcccatcaaaagtgcccgctaccgtggccagcacagctcctacccaatcaagctgttctacaccagcaacatcccaatcatcctgcaatctgcgctggtctccaacctgtacgtcatctcccaaatgctggcaaccaaattcggcggcaacattctggtcaacctgctcggccagtggtccgactcaaccggctaccgcagctatccaaccggcggcctctgctactacctgtcaccaccggagtcactctcgcacatcctggaggacccaatccactgcatcatctacattgtcttcatgctcggctcgtgcgccttcttctccaaaacatggattgatgtgagcggctccagcgccaaggacgtggccaagcagttgaaggaacaacaaatgatcatgcgcggccatcgcgagaagtccatgatccacgaactgaaccgatacatcccaaccgcagcagcattcggcggactttgcattggcgcattgtctgtcacggcggacttntnngnagccattggaagcgggactggaatattgctggccgtcaccatcatctatcagtatttcgagatattcgtcaaggaacagcaagagatgggcggaatttcgggcctcttcttcnnn

SEQ ID NO: 870 - DNA, 810 bp, Artificial Sequence
  Description of Artificial Sequence: Synthetic polynucleotide
  modified_base (1)..(225): a, c, t, g, unknown or other
  modified_base (232)..(232): a, c, t, g, unknown or other
  modified_base (234)..(235): a, c, t, g, unknown or other
  modified_base (240)..(240): a, c, t, g, unknown or other
  modified_base (243)..(243): a, c, t, g, unknown or other
  modified_base (246)..(246): a, c, t, g, unknown or other
  modified_base (389)..(389): a, c, t, g, unknown or other
  modified_base (480)..(480): a, c, t, g, unknown or other
  modified_base (540)..(540): a, c, t, g, unknown or other
  modified_base (549)..(549): a, c, t, g, unknown or other
  modified_base (601)..(810): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagantnnacttnttnccngtcgatgaacgactcgtcccacttgaacacgaagaaagcaacagcggcgccctccaacggcttttgcctgctgacaagcgagtgctgcaattgacaaatgatctgctcgaggacggcttcaaggcggcacaacaatttgaacnacagctgcgcaacctgaacccgccaatcaacgaaaacggcttcccaatcttcgatctgctgcttcttggacttggaccggatgggcacacntgctcactcttccctggacaccggctgctttctgaagacacggttgcggtttgggtcacncacttggangactcgccaaagccgccgccacgccggatcactgtcactttgccggttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 871 - DNA, 1377 bp, Artificial Sequence
  Description of Artificial Sequence: Synthetic polynucleotide
  modified_base (1)..(600): a, c, t, g, unknown or other
  modified_base (873)..(873): a, c, t, g, unknown or other
  modified_base (898)..(901): a, c, t, g, unknown or other
  modified_base (905)..(905): a, c, t, g, unknown or other
  modified_base (907)..(907): a, c, t, g, unknown or other
  modified_base (909)..(909): a, c, t, g, unknown or other
  modified_base (954)..(954): a, c, t, g, unknown or other
  modified_base (963)..(964): a, c, t, g, unknown or other
  modified_base (1008)..(1008): a, c, t, g, unknown or other
  modified_base (1062)..(1062): a, c, t, g, unknown or other
  modified_base (1071)..(1071): a, c, t, g, unknown or other
  modified_base (1086)..(1086): a, c, t, g, unknown or other
  modified_base (1116)..(1116): a, c, t, g, unknown or other
  modified_base (1131)..(1131): a, c, t, g, unknown or other
  modified_base (1146)..(1146): a, c, t, g, unknown or other
  modified_base (1149)..(1149): a, c, t, g, unknown or other
  modified_base (1173)..(1174): a, c, t, g, unknown or other
  modified_base (1176)..(1176): a, c, t, g, unknown or other
  modified_base (1216)..(1377): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgccctgagaaagtcgaaagtgcgaaacttgcgagtgctgggcagacgggggccgaaagaaatttccttcacaatcaaagaactccgcgaactgctcaccctggagcgagtgcatgcccattgcgcaattggcggggatgttgtgaagcagctgcaacaggaattgcccaaaatggaaaggcccagacggcgtttgatggagctgatgctttcctatgctgccgagggaagaaggcaaaaaaccctccaattgctgttccaccgccgcccnctggccattgaggtggattcttccnnnngtgncngngcaattcgcgtccaaaattcccttacgcgcagtgaggagacaatnccctgcggnntgctgatctatgccattggatttgagcatctgctgttgaatggngtgccaagagcggaaaatgggcagctgaaaatggccgactggtgtcgggtgccngagcaaagngcagcggtaaatttngtttatgccaccggatggtgttcccatgcngcccgtggcttgatngcagacagtcagcancangcctactcggttgcggatcaaatnntngaggattgggaacaacaaaggattgcactgaaatcgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 872 - DNA, 2370 bp, Artificial Sequence
  Description of Artificial Sequence: Synthetic polynucleotide
  modified_base (1)..(102): a, c, t, g, unknown or other
  modified_base (313)..(313): a, c, t, g, unknown or other
  modified_base (324)..(324): a, c, t, g, unknown or other
  modified_base (327)..(327): a, c, t, g, unknown or other
  modified_base (345)..(345): a, c, t, g, unknown or other
  modified_base (348)..(348): a, c, t, g, unknown or other
  modified_base (457)..(458): a, c, t, g, unknown or other
  modified_base (465)..(465): a, c, t, g, unknown or other
  modified_base (481)..(481): a, c, t, g, unknown or other
  modified_base (504)..(504): a, c, t, g, unknown or other
  modified_base (522)..(522): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (670)..(672): a, c, t, g, unknown or other
  modified_base (832)..(833): a, c, t, g, unknown or other
  modified_base (835)..(835): a, c, t, g, unknown or other
  modified_base (840)..(840): a, c, t, g, unknown or other
  modified_base (849)..(849): a, c, t, g, unknown or other
  modified_base (861)..(861): a, c, t, g, unknown or other
  modified_base (876)..(876): a, c, t, g, unknown or other
  modified_base (918)..(918): a, c, t, g, unknown or other
  modified_base (930)..(930): a, c, t, g, unknown or other
  modified_base (936)..(936): a, c, t, g, unknown or other
  modified_base (954)..(954): a, c, t, g, unknown or other
  modified_base (960)..(960): a, c, t, g, unknown or other
  modified_base (1101)..(1101): a, c, t, g, unknown or other
  modified_base (1131)..(1131): a, c, t, g, unknown or other
  modified_base (1141)..(1142): a, c, t, g, unknown or other
  modified_base (1144)..(1145): a, c, t, g, unknown or other
  modified_base (1147)..(1148): a, c, t, g, unknown or other
  modified_base (1365)..(1365): a, c, t, g, unknown or other
  modified_base (1375)..(1378): a, c, t, g, unknown or other
  modified_base (1380)..(1380): a, c, t, g, unknown or other
  modified_base (1382)..(1382): a, c, t, g, unknown or other
  modified_base (1384)..(1384): a, c, t, g, unknown or other
  modified_base (1401)..(1401): a, c, t, g, unknown or other
  modified_base (1435)..(1435): a, c, t, g, unknown or other
  modified_base (1437)..(1437): a, c, t, g, unknown or other
  modified_base (1494)..(1494): a, c, t, g, unknown or other
  modified_base (1515)..(1515): a, c, t, g, unknown or other
  modified_base (1542)..(1542): a, c, t, g, unknown or other
  modified_base (1551)..(1551): a, c, t, g, unknown or other
  modified_base (1974)..(1974): a, c, t, g, unknown or other
  modified_base (2079)..(2079): a, c, t, g, unknown or other
  modified_base (2127)..(2127): a, c, t, g, unknown or other
  modified_base (2136)..(2137): a, c, t, g, unknown or other
  modified_base (2142)..(2143): a, c, t, g, unknown or other
  modified_base (2151)..(2151): a, c, t, g, unknown or other
  modified_base (2175)..(2175): a, c, t, g, unknown or other
  modified_base (2190)..(2190): a, c, t, g, unknown or other
  modified_base (2211)..(2211): a, c, t, g, unknown or other
  modified_base (2259)..(2259): a, c, t, g, unknown or other
  modified_base (2292)..(2292): a, c, t, g, unknown or other
  modified_base (2295)..(2295): a, c, t, g, unknown or other
  modified_base (2298)..(2298): a, c, t, g, unknown or other
  modified_base (2301)..(2308): a, c, t, g, unknown or other
  modified_base (2310)..(2310): a, c, t, g, unknown or other
  modified_base (2312)..(2313): a, c, t, g, unknown or other
  modified_base (2315)..(2315): a, c, t, g, unknown or other
  modified_base (2317)..(2321): a, c, t, g, unknown or other
  modified_base (2324)..(2324): a, c, t, g, unknown or other
  modified_base (2326)..(2326): a, c, t, g, unknown or other
  modified_base (2329)..(2329): a, c, t, g, unknown or other
  modified_base (2331)..(2332): a, c, t, g, unknown or other
  modified_base (2334)..(2335): a, c, t, g, unknown or other
  modified_base (2340)..(2340): a, c, t, g, unknown or other
  modified_base (2368)..(2370): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccaaaggcagccagccgccatttggaagattccgctggcggtgccgaacttgaggacgagtttggcgcccgcgactaccgcaaagaggtgcagctgaagaaggaccacaactctcgccccctgtgggttgcccccgatggacatgttttcctggaatcgttctcgcccgtctacaaacatgcagccgactttttgattgcaattgctnagccaatttgncgnccggaattcattcacgantancaactgaccgcctactccctctatgccgccgtttccattgggctccaaaccaaggacatcatcgaatatttggacagactttgcaagaccacactgcccgagggaattnnaaaattnattgaggtttgcactntgagctacgggaaagtgaagctngtgctgaagaggaacaantacttcatcgagtcccgncantcngacgtcattcagcgattgctcaaggacaaagtcatccaggagtgtttggtggaaagcgccgacagtgctgcaatcgcccaaactgttggggcggaggagaaaagccaaatcgagtttcccaccnnnatggcaaagacgacaaccggcggggaagcaggcaaagatgccgaaaatggggacaaaaatggccaggaagtgccggaggatattgacaaattctacgagaaattgacgggggacgaggaggacgatgacgagatgcgcaacctggaagtgctcgcgtttnnanttcgncaagagtcnattgagaatgtncaaaaacgctgcatngagttggagtacccgctgctggccgagtacgatttccgcaangacacgaacaancccaanctgaacattgacctgaanccgacnaccacactcaggccatatcaagagaaaagtttgcgcaaaatgtttggtaacagccgtgcccgttccggtgtcatcgttttgccatgtggggccggcaaaacgttggtgggtgtcaccgcagcatccacaatcaacaaacgntgccttgtgctggccaccagcaatgtcagngttgagcaanngnngnnacagtttcggctttggtccaccatccaggacaaccaaatcattcgcttcactcgcgacgctcgagacattgtgcccactgggccggatgcaaacaaacccacagtgtgcatcagcacctactccatggtggcctacacgggcaagcgggcgtacatggccgaggaggcaatgcgatacattgagaaccaggagtggggactgctcctgcttgatgangtgcacacannnncngncnaaatgttccgccgagtnctgaccattgtgcgggcccattgcaaactcgggntnacggccactctggtcagggaggacgacaaaatcacggacctgaactttttgattggnccaaagatttacgaggccaantggatggaattgcaaaaggccggccanattgcgagngtgcaatgcgcagaggtttggtgcccaatgacagcggaattcttcgattattacttgaaatccagtcagaacagaaaattgttgttggccgtgatgaacccaaacaaattccgcgtctgccaatacctaatccgtttccatgaacgccgaaatgacaagattattgtgttctcggacaatgtgttcgcactgaagaattacgcggagaagatgaagaaacccttcctttttggccagacttcccaagcggaacggatgagggttttgcagaatttccaattcaatccaaaagtgaacacaatttttgtttccaaggtcgccgatacctcttttgatttgcccgaagcaaatgtgctcatccaaatcagcgcccatggcggttcccggcgtcaagaggcacaaagattgggacggattttgcgngccaagaaattcaccgcggacgcgttcaacgcctatttctactcgctggtctcgcaggacaccgtggaaatggcctactcgcgcaagaggcaacgctttttggtnaatcagggatatgcttacaaggtggtcaacgagttcccggacatggcnaaggagcanntgganntggccacnaaggacgagcagttgaagctgctnagtcaagtgctgcangccagtgatgcggaaatcctngaggaagacccaaaggacgagttgattgacggcccagcgagggccacncgcaaggaagtggacttggccgcattctcgggngcnaangcnnnnnnnnananngnannnnngangngangnncnnagagncacccactgttcaagcgattcagaaaannn

SEQ ID NO: 873 - DNA, 3699 bp, Artificial Sequence
  Description of Artificial Sequence: Synthetic polynucleotide
  modified_base (48)..(48): a, c, t, g, unknown or other
  modified_base (283)..(283): a, c, t, g, unknown or other
  modified_base (285)..(285): a, c, t, g, unknown or other
  modified_base (288)..(292): a, c, t, g, unknown or other
  modified_base (294)..(303): a, c, t, g, unknown or other
  modified_base (305)..(306): a, c, t, g, unknown or other
  modified_base (313)..(317): a, c, t, g, unknown or other
  modified_base (319)..(321): a, c, t, g, unknown or other
  modified_base (324)..(324): a, c, t, g, unknown or other
  modified_base (326)..(328): a, c, t, g, unknown or other
  modified_base (330)..(331): a, c, t, g, unknown or other
  modified_base (334)..(335): a, c, t, g, unknown or other
  modified_base (338)..(338): a, c, t, g, unknown or other
  modified_base (340)..(340): a, c, t, g, unknown or other
  modified_base (342)..(342): a, c, t, g, unknown or other
  modified_base (345)..(345): a, c, t, g, unknown or other
  modified_base (348)..(350): a, c, t, g, unknown or other
  modified_base (352)..(354): a, c, t, g, unknown or other
  modified_base (358)..(360): a, c, t, g, unknown or other
  modified_base (376)..(376): a, c, t, g, unknown or other
  modified_base (378)..(378): a, c, t, g, unknown or other
  modified_base (381)..(381): a, c, t, g, unknown or other
  modified_base (395)..(395): a, c, t, g, unknown or other
  modified_base (400)..(400): a, c, t, g, unknown or other
  modified_base (412)..(412): a, c, t, g, unknown or other
  modified_base (465)..(465): a, c, t, g, unknown or other
  modified_base (522)..(522): a, c, t, g, unknown or other
  modified_base (531)..(531): a, c, t, g, unknown or other
  modified_base (544)..(544): a, c, t, g, unknown or other
  modified_base (549)..(549): a, c, t, g, unknown or other
  modified_base (555)..(555): a, c, t, g, unknown or other
  modified_base (570)..(570): a, c, t, g, unknown or other
  modified_base (579)..(579): a, c, t, g, unknown or other
  modified_base (597)..(597): a, c, t, g, unknown or other
  modified_base (626)..(626): a, c, t, g, unknown or other
  modified_base (628)..(628): a, c, t, g, unknown or other
  modified_base (1053)..(1053): a, c, t, g, unknown or other
  modified_base (1081)..(1083): a, c, t, g, unknown or other
  modified_base (1185)..(1185): a, c, t, g, unknown or other
  modified_base (1354)..(1356): a, c, t, g, unknown or other
  modified_base (1632)..(1632): a, c, t, g, unknown or other
  modified_base (1686)..(1686): a, c, t, g, unknown or other
  modified_base (1719)..(1719): a, c, t, g, unknown or other
  modified_base (1761)..(1761): a, c, t, g, unknown or other
  modified_base (1809)..(1809): a, c, t, g, unknown or other
  modified_base (1815)..(1815): a, c, t, g, unknown or other
  modified_base (1881)..(1881): a, c, t, g, unknown or other
  modified_base (1893)..(1893): a, c, t, g, unknown or other
  modified_base (1914)..(1914): a, c, t, g, unknown or other
  modified_base (2256)..(2256): a, c, t, g, unknown or other
  modified_base (2416)..(2418): a, c, t, g, unknown or other
  modified_base (2482)..(2736): a, c, t, g, unknown or other
  modified_base (2917)..(3024): a, c, t, g, unknown or other
  modified_base (3195)..(3195): a, c, t, g, unknown or other
  modified_base (3270)..(3270): a, c, t, g, unknown or other
  modified_base (3301)..(3301): a, c, t, g, unknown or other
  modified_base (3337)..(3420): a, c, t, g, unknown or other
  modified_base (3607)..(3609): a, c, t, g, unknown or other
  modified_base (3694)..(3699): a, c, t, g, unknown or other
atggctttattgaagaaatttgaatcgaaaagcgcaagagtgaaagcnatttcctttcatccaactcggccatgggttttggcctctttgcacagtggtgtcatccaactttgggattatcgaatgtgcgtgttaattgacaagtttgatgaacatgatgggcccgttcggggcgttgatttccattctcaacaaccaatctttgtttccggcggagatgactacaaaattaaggtgtggaattacaaacagcggaagtgcattttcacactgctcggacatntngannnnntnnnnnnnnnntnnttccacnnnnnannnccntnnntnnttnncgntncngangannnannngtgnnnatgtggaattacaaananagnaagtccattgcaanacttngaggacacaacnattatgttatgtgcgctcaattccatccaagcgaggatttggtggcaagtgcnagcttagatcagactgttcgaatatgggatatcagtgggttgaggaagaagaacacngctcctggnggaggacccggtntgccnagtgtntctgcacaaaccganttgttcggncagcccgatgtagtggtnaaacatgttctggaagggcatgaccgagntntgaactgggtgtcattccacccgacaatgccattacttgtttccggtgctgacgacagacaagtgaaaatgtggcgttacaatgaaagcaaggcttgggaagtggatgcttgtcgaggccactacaacaatgtttcatgcgtcattttccacccaaaagcggaactgatactttccaattccgaagacaaaagtattcgtgtttgggacatgcaaaagcgcacttgtcttcagaactttcgacatgagaacgatcgtttttgggtgctagccgcacatccttccctgaatctctttgctgctgggcatgacaatggaatgattgtgttcaaaacagaacgcgaacgaccaccttattgtgttcatgagaattttgctttttatgtcaaagagaagcaaatgcgacgccttgatttgacaacaaanaaagacacggcattggctcaacttaaannngccaacaaacttacacagccattttattcgctgcattataatccggccgagaattgtttcttgcttgttacgcgcccttccaataacattgaaatagcacancaaaattatttacagatttcttcaaaagaaggtgaacttgagccggcagaggtgaagtcgcctggaatagcagctatatgggtggccagaaaccgatttgctgtgctggacaaaacacaccaattgacaatacgcgatctgcaaaatcaagagagccgaaaaattgatnnntacaacgggcctgtcgatgacattttctatgctgggaccggcttgctattgctcaagaatccggacaatgtgcaaatgtacgatgtccaacaaaagcgcatcctggccactttgaaagttagcaaggttaaatatgtaatttggtcgaagaatatggaatttgcggcacttctcagtaaacacacagtcactttggttaccaggaaattagagttgctttgctccgtccaagaatcaacgcgtgtgaaaagcggtgcttgggatgacaacgatgcnttcctctacacaacatcaaaccacataaaatacgcactcacgggcggagatcanggcataatccgcacaatggacattcctgtgtanatactcgctattcgcggcaatcgcctctattgtttgagccgngaggcggcaccaatcgaattgacaattgatccgactgaatatcgcttnaaattngcattaatccatcgacgatatgatgaagtcctgaacatggtgcgcagtgccaatttggtcggccantcaatcatagcntttctgcaaaagaagggctancccgaggttgctctccactttgtgaaggacgaaaagacccgttttggattggcacttgaatgtggaaatcttcagattgccatggaagcggcaaaagttctagatgacaaagccgcatggactgccctgggcgaagctgctttaatgcaaggcaaccaccaaattgtggaaatggcttatcaacggacaaaagattttgagcgattggcattcctttatttgatcacaggaaacacggagaaactgcaaaaaatgcagaaaattgcacaaattcgaaaagatgttcatggccagttccaatgtgcgctcatgcttggcgatgctgaagaaagaacaaaagtnttgaaagaattgggacaacttccattggcctatctctcagccacaaccaatggtcttcaggaggaggcagcacagttgggtgctgagctcgagcaaaaacacatttcaattcctgacacaaaccccaatgcccaaccattggtgccgccaaaaccaatcnnnaacatggtggaaaattggccacagctcactgtatcgaccgggccttttgatgcacaattgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtgtacaccgtgccacagcgtggacatccacccccattttattggccaggaaattcacgtctagtcgctgaccatgttgcagcaggcaattttgacacggctgcgagaatactcgaggaaaccatcggcgctattcagttgggcccattcaaagcacttttcttatcaatttatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcttcagctaaatgatttggcccaacgtttgcaaatctgctatcagctgaccacacagggcaagttcggcgatgcggttcagcgtttccgacaaatattacttgccattcctttgctagtggttgattcaaaacaagaggtcatcgaggcccagcaattgctgcaaatntgtcgcgaatatttggttggtttgttgctggaatcggcgcgcaaagaacttccgagagagtcggtcaatgatgcnaagcgcaatctggaaatggccgcctacttcncgcattgcgaaatccagcctgtccataaaatcttgnnnnnnnnnnnnnnnnnnnnnnnnnnnnnnnnnnnnnnnnnnnnnnnnnnnnnnnnnnnnnnnnnnnnnnnnnnnnnnnnnnnnggaccaaaaccagaaattgcggcccaaatgagaaaaatgctcgcagtagcggagcgagacaacagcaatgcttttgagttgaattacgatgagcacaatccattcgtgctctgttcccgcactttcatgccactctaccgaggcaaaccccaagtgaaatgtcccttctgcggtgccagctactcgnnnggccacaatggcacagtctgtgatgtttgtgaggtggccgaaataggcaaggatgtgcagggactgcgaatttccactgtgcaannnnnn

SEQ ID NO: 874 - DNA, 834 bp, Artificial Sequence
  Description of Artificial Sequence: Synthetic polynucleotide
  modified_base (1)..(48): a, c, t, g, unknown or other
  modified_base (285)..(285): a, c, t, g, unknown or other
  modified_base (388)..(390): a, c, t, g, unknown or other
  modified_base (832)..(834): a, c, t, g, unknown or other
nnnnnnnnnnnnnnnnnnnnnnnnnnnnnnnnnnnnnnnnnnnnnnnnataaatttattccattttaagagtggcggaactcgcgtcaagcttgagaagactgctgtacgatttattgagaatttttctatgggtaccagaggagctgccagcgcagagtatgtttacaccctttcattttatcccttatcaaagcaccgtgaagaatcattaaagccattttccagaaaatatcttcatttctttgatcatttggagcttagggaagacggcgaagtgacaacntttccatcactacctgcagacgttgccaagtttaagaaatattccaaaaatctcctgttcatcccattcaccgatttggagcagtatttacacgatttggagnnnatctgttcagcgttgaatgcaattggtcgcagagcattgatttacttggcagctgcagtgtcagacttttacattcgcgaattgccaacacacaaaattcagtcttccagagaattgcagttgacactcagcattgtgccaaaactattagagcgcttagtgaacaaagtggtgccaaatgcttacataatttcgttcaagcttgaaacggacgacagcattctcatcgacaaagccaaaggtgcccttgagaagtacggtcacagcgcagtcatcggaaatttactgcaaacgaggaagaagcatgtggtgtttgtttatccgaatgggaggcctacagaatccgtcgatttatccgaagaagccaaaggtgcggagattgaggaaaggattgttgagaagttggcggaacagcacggacagtttatcggctccacactannn

SEQ ID NO: 875 - DNA, 819 bp, Artificial Sequence
  Description of Artificial Sequence: Synthetic polynucleotide
  modified_base (156)..(156): a, c, t, g, unknown or other
  modified_base (261)..(261): a, c, t, g, unknown or other
  modified_base (312)..(312): a, c, t, g, unknown or other
  modified_base (315)..(315): a, c, t, g, unknown or other
  modified_base (321)..(321): a, c, t, g, unknown or other
  modified_base (567)..(567): a, c, t, g, unknown or other
  modified_base (723)..(723): a, c, t, g, unknown or other
  modified_base (808)..(819): a, c, t, g, unknown or other
ttaaaaaatgtaattgcagttattggaccggccgggagtggcaaatcaacctattgcgccacaatacaaaatcactgcaaaaccgtgggaaagtccgtatttgtggtaaacctcgatccagctgccgaatccttctcctatgagtgcgcaatcatnattcgggaattgatcagtgtggaggatgttctcgaggaagagcaactctcgatggggccaaacggtgctctggtctattgcatggaatatttggcggacaacctngagtggctccacgagcagctcaacgagggagaggatgactactttctgttngantgcccngcccaaatcgagttgtacagccacttgccggtgatgaggcagattgcgacggccctccagcagtggaatttcaatgtttgcaccaccttcattctggacaccagcttttgcatggaccccgacaaattcatttccgcatcgctgaccaccctctccacactggtctcgatgatgacgccctcggtgaatgtgctcagcaaaatggacttgctgagcgcggaggaaaggcattcggtccaggaactnttggaaggggatttgcagcaaatccatgataaagaaacaacaaagtggaatgaggagcacagtgaactgaccaaggcaattgcgacaattctgggcgactacaatttggtcaagtttctgcctctcgacattgaggatgaggaatccattgaaatncttttgatggcaataaatggagtcatccaattcggagaggacgccgatgtcaaggaccgctatccggaggaattggaaagcgaannnnnnnnnnnn

SEQ ID NO: 876 - DNA, 327 bp, Artificial Sequence
  Description of Artificial Sequence: Synthetic polynucleotide
  modified_base (1)..(111): a, c, t, g, unknown or other
  modified_base (199)..(199): a, c, t, g, unknown or other
  modified_base (255)..(255): a, c, t, g, unknown or other
  modified_base (325)..(327): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtccagccgagtgtacccgaagaaaaaggaggaggagaaaattctgggcggcaccgagaagtgggagaatgcgcaaattgcaaacngacgctgcccaaagtgcgcccatgacaaggcctacttccaccaagtgcagacccgnagtgccgacgagccaatgacaattttctaccgttgcgccaacccgaattgtgctcaccgatggaaggaannn

SEQ ID NO: 877 - DNA, 1344 bp, Artificial Sequence
  Description of Artificial Sequence: Synthetic polynucleotide
  modified_base (1)..(162): a, c, t, g, unknown or other
  modified_base (322)..(465): a, c, t, g, unknown or other
  modified_base (649)..(840): a, c, t, g, unknown or other
  modified_base (1056)..(1056): a, c, t, g, unknown or other
  modified_base (1189)..(1197): a, c, t, g, unknown or other
  modified_base (1339)..(1344): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccaaacgtcctttatactggctttgatccaacttcagatagctttcacattggaaatctgttcattttatcaacgttgatccgttcagcaactttcaaatgtacaccgattatattaataggagaagcaactgctttagttggtgatccgagtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctgaagatgctagacttcatggtattaagcaaaagatttcgaattggcgagatgttgagactgggcccaataaaatcacgacttgaggaaggattgtcattttcagaattttcataccaaattttgcaagcaaatgattggctaaccctttccaaaatgcatgattgttactgtcaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattgtgagattacagatcacacagcagaagagtttccttgttcgtttctcattaaagccatatgaagaaattgaagagttgctcaaactacacaattcgcaaattggcaaatggattgctcaaactcatttggcggaagaaatgacctcattggtgcatggccatgctggcttgcaactggcaaagagatgctcatctatcctttatgatgcntcaataaatgatttggaagaattggatgctgatacaataaaagacctgtttgcatcaacccacaaaatccccaagagttcaatcaaaacaatgggccaaattgcagaagcaacacgcaagggaggtggaaaannnnnnnnnaccatgaggacgggggcattcagaatcaatggagtgaaaatggaaaatcccgatcagaatgtcgagctgaagcaaatcctgatacaaaatcaatttacacttgtttgttggggaaaacgaaagttttcattaattttatggnnnnnn

SEQ ID NO: 878 - DNA, 546 bp, Artificial Sequence
  Description of Artificial Sequence: Synthetic polynucleotide
  modified_base (1)..(39): a, c, t, g, unknown or other
  modified_base (156)..(156): a, c, t, g, unknown or other
  modified_base (271)..(546): a, c, t, g, unknown or other
nnnnnnnnnnnnnnnnnnnnnnnnnnnnnnnnnnnnnnncaggtcagttccgagctgttctgcctcacctacggcgccctggtcaatgacctgatgaacgatttggagtcgccggaggaagtgaaccggcagttggacaaaattggctttaacatnggtctccgcctggccgacgactttttggcgaagaacccgcgggtgggcaaatgctcggaaattcaacaaatcatggagatcattgtgaagagtggattcaaggcttacttaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 879 - DNA, 1938 bp, Artificial Sequence
  Description of Artificial Sequence: Synthetic polynucleotide
  modified_base (1)..(117): a, c, t, g, unknown or other
  modified_base (126)..(126): a, c, t, g, unknown or other
  modified_base (162)..(162): a, c, t, g, unknown or other
  modified_base (216)..(216): a, c, t, g, unknown or other
  modified_base (258)..(258): a, c, t, g, unknown or other
  modified_base (294)..(294): a, c, t, g, unknown or other
  modified_base (348)..(348): a, c, t, g, unknown or other
  modified_base (358)..(358): a, c, t, g, unknown or other
  modified_base (384)..(384): a, c, t, g, unknown or other
  modified_base (450)..(450): a, c, t, g, unknown or other
  modified_base (485)..(486): a, c, t, g, unknown or other
  modified_base (492)..(492): a, c, t, g, unknown or other
  modified_base (510)..(510): a, c, t, g, unknown or other
  modified_base (519)..(519): a, c, t, g, unknown or other
  modified_base (524)..(524): a, c, t, g, unknown or other
  modified_base (528)..(528): a, c, t, g, unknown or other
  modified_base (558)..(558): a, c, t, g, unknown or other
  modified_base (621)..(621): a, c, t, g, unknown or other
  modified_base (652)..(696): a, c, t, g, unknown or other
  modified_base (1075)..(1077): a, c, t, g, unknown or other
  modified_base (1167)..(1167): a, c, t, g, unknown or other
  modified_base (1326)..(1326): a, c, t, g, unknown or other
  modified_base (1557)..(1557): a, c, t, g, unknown or other
  modified_base (1815)..(1815): a, c, t, g, unknown or other
  modified_base (1933)..(1938): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaaatncgcaattttgctatcattgctcacatcgatcatgcnaaaagcacattatcagacaggcttctgcaattgaccaatgttatccccgattcngatgcccaataccttgacaaactacaagtggaaagggagcgnggaataactgtgaaagcccaaacttgcacaatgttncatcgagagcacatgctaaatttgattgactgtccgggccatgtggattttagntttgaagtgnaacgttctctagttgcgtgtgatggntgtttgttgctggttgctgctaatcagggtgtccaagcgcaaacaatttttaatttttggtctgcntttgaagcaaatctcacaattatcccggtgattannaaagtngatatgcccggtgtggangtcgaacgngtggnacgncaattgcaaaaccttttcgatttttgcccngatgaaatgctgaggatttccgcaaaacggggaacaaatgtgccagccttgttggattccatngtcgacagattgccggcaccaaaagttgtcnnnnnnnnnnnnnnnnnnnnnnnnnnnnnnnnnnnnnnnnnnnnncacatacaaggcgcaatcttgcttgtgctggtcaaagaggggaaattgcgccgaaacatggccatccgctttttaaatagcgaaagggaatacattgtcgcagaggttggcttccttcatcccgaaatgatgccatgcgaggcattgaatgccggccaagttggtttcatccattgcggcatcaaatccacccgggatgttattgtgggtgacaccctcttcgatgccaaactccctgcagcggagattaagccatttgtggaaataacgaggataaagccaaccgtttattccggcctgtttcccgtgcaacctgcagattatgagcaattgaagcaagctgtggaaacccttcacctgaatgattcttccgttgacnnnttagccgacacaagccctgtattcggccaaggctggcgcgtcggttttgttggcaatttgcacatggaagtgtttggacaaagattgganaaagagcatggcgaattggcagtgttcacaaaccccagtgtggaatacctggctgagattgtggacaatgagagcatccggaagaagcgctacggtgggcaatcccggattgtcatctcaaaaccttctgcctaccctgaacatatggacatttctagntattttgaaccaatggccttggtcaccattgttgcccaatccgatcatttgccggcaattgaccaactttgcatgaaggcacgcggagaacgcatcgagaacaccttcattgaccagcagcaatgcctgttgaagtggcgaatacccttggtggaggcaatcaccaactttttcgacaatctcaagcgaatcagcagcggatatgcttcatttgacatgaaggatgacgcntacgcggaatgcaagctggagaaagtgtgcatttacatcaatgacaagcccatcgatgagctgtcaatgatttgcccaagttcgagggcgcatgccaatgcaaaaagaatcgtcgaaaagttgaaagaggaaattccccgccagcaatatgaagtcaacatttctgcctcacttggacactcgaagaaggcaattgcccggacgttggtgaaaccggtgaagaaggattttgccggcgtcatgaaaggtggaaacggnaatttcgttgccgaccgacttggcaaaaagatgagacaccaacaagagggaaaagaacgaatgaaaatgctagggaatatacaagtaccacgcgaagtcttcctcaatgttgttaggnnnnnn

SEQ ID NO: 880 - DNA, 525 bp, Artificial Sequence
  Description of Artificial Sequence: Synthetic polynucleotide
  modified_base (1)..(123): a, c, t, g, unknown or other
  modified_base (216)..(216): a, c, t, g, unknown or other
  modified_base (331)..(331): a, c, t, g, unknown or other
  modified_base (333)..(334): a, c, t, g, unknown or other
  modified_base (342)..(342): a, c, t, g, unknown or other
  modified_base (360)..(360): a, c, t, g, unknown or other
  modified_base (398)..(398): a, c, t, g, unknown or other
  modified_base (439)..(439): a, c, t, g, unknown or other
  modified_base (483)..(483): a, c, t, g, unknown or other
  modified_base (517)..(525): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtctaaaaacgagcaacagcagcaacacttgttgggcaaaagggcgtgggacattgcgctgggcccaatgaaggcgttgccgatgaacgtnttcatgatgtacatggccggcaacacaatctccatattcccaatcatgatggtcgcaatgatggcctggcgacccgtgaaggctttcatgtcagtgaacaccgtgttcaagccgntnnagcaagantacatgggcactctgctnctccacaaaatcatcttcgtcctcggcaatttggccgncattggcttggccgtctacaaatgccacacaatgggactgntgcccaaccatgagtcggactggctggactttatggatgctccngagagaatgcaatttgccttattcaatgatgttnnnnnnnnn

SEQ ID NO: 881 - DNA, 645 bp, Artificial Sequence
  Description of Artificial Sequence: Synthetic polynucleotide
  modified_base (1)..(3): a, c, t, g, unknown or other
  modified_base (84)..(84): a, c, t, g, unknown or other
  modified_base (93)..(93): a, c, t, g, unknown or other
  modified_base (126)..(126): a, c, t, g, unknown or other
  modified_base (150)..(150): a, c, t, g, unknown or other
  modified_base (162)..(162): a, c, t, g, unknown or other
  modified_base (168)..(168): a, c, t, g, unknown or other
  modified_base (174)..(174): a, c, t, g, unknown or other
  modified_base (178)..(178): a, c, t, g, unknown or other
  modified_base (180)..(180): a, c, t, g, unknown or other
  modified_base (189)..(189): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (222)..(222): a, c, t, g, unknown or other
  modified_base (230)..(230): a, c, t, g, unknown or other
  modified_base (234)..(234): a, c, t, g, unknown or other
  modified_base (246)..(246): a, c, t, g, unknown or other
  modified_base (264)..(264): a, c, t, g, unknown or other
  modified_base (438)..(438): a, c, t, g, unknown or other
  modified_base (640)..(645): a, c, t, g, unknown or other
nnncaaaacttaaagaagtttactgcatttggtcggaaaatagtttgtgttggaaggaactatcgagatcatgcgcttgaaatnaacaatccnattcccgtgacgcctttgatttttgccaaaacnacaaatgcttatgttcaaaatggnggagcaattganattccngatggntgcnanaatttgcantacgaggttgaattgggcgttgtnatntcncanaatgcgcngaangtcgcgaaagantcggcttttaattacgtnggaggctacacaattgcgttggatatgacggcccgagacattcaggacacattgaaaaaggagggcaatccttggtacttggcaaagtcattcgacacttcttgtccggtcggggaattcatcggcaaagaggccgtacaagatccacacaatgttgagatctattgcaaatanaatggaaaatatcgtcagaaatcaaggacggactgcatgattttcgacatttcaacgctgatcgagttcatcacaaggacaatcactctatacccaggcgaccttctcttaacgggcactcctgccggtgttggccaatgctattctggcgatgaaatagaaatcgggatcagcgagataacaagtgccaaattcaaagtcnnnnnn

SEQ ID NO: 882 - DNA, 879 bp, Artificial Sequence
  Description of Artificial Sequence: Synthetic polynucleotide
  modified_base (474)..(474): a, c, t, g, unknown or other
  modified_base (750)..(750): a, c, t, g, unknown or other
  modified_base (838)..(879): a, c, t, g, unknown or other
atgcttcgacgacaagttcgtgaacgccgcgagtatctgtaccgcaaaaatttggatgctcgacaacgatccacacaggaacgccgaaatcgcatcaaacatgcattggacaccagcagcgcattgccaacggatttgcgcaaggatgcggccgaaatggtgggcgacttggcgtggggagaccaagtggacccggtggatgatgagtaccgatgggcgggatgcgatgacccgagcattgtggtcaccacaagtcgagatccctcctcgcggctgaagatatttgccaaggagatgaagctgcttctgcccaactcaagacgcatcaatcgcggtgggcacgacatgaagaccatcgtggacgcttgcaagtcgcacggagtcaccgatctggtgttgctgagcgaaacacgcggtgttcccgactcaatgattgtctcacactttccgcacggtccgactgcgtatttctgnttgtcaaatgttgtgatgcgccacgacatcccggacatgccgcacatgtcggagcagtatccgcacctcattttccacaatatcacatcgaatctgggcaaaagggtcaccagcatcctcaagtacctgttccccgtgcccaaaaaggactcacagcgcgtgatcacgttcgccaacgaggaggatttcatctcattccgtcagcacacatggaagaagggggatggcggcgaaattgagctgaccgagttggggccacgctttgaacttcgaccntactgcatcgttttgggaacagtggagaatgcggactcaagtgaaaccgagtgggctcttcgcagctacatcaatcgcaagaggaaannnnnnnnnnnnnnnnnnnnnnnnnnnnnnnnnnnnnnnnnn

SEQ ID NO: 883 - DNA, 1869 bp, Artificial Sequence
  Description of Artificial Sequence: Synthetic polynucleotide
  modified_base (1)..(606): a, c, t, g, unknown or other
  modified_base (841)..(1002): a, c, t, g, unknown or other
  modified_base (1153)..(1155): a, c, t, g, unknown or other
  modified_base (1360)..(1395): a, c, t, g, unknown or other
  modified_base (1741)..(1743): a, c, t, g, unknown or other
  modified_base (1843)..(1869): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaagaaatgcgcaaaatcattggtcgatacggcctttcgggacgagaacaaatttgtccaatgaaacaattgtcggatgggcaacgatgtcgagtcgcatttgcatggcttgcttggcaacaacctcatcttcttcttttggatgaaccaacgaatcatttggacatggaaagcatcgacgcattggccgaagcaatcaacaatttcgctggtggaatgattttggtgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttaaggattatgttgctcgttttggacatggaagtgcaaaattggctcgtcaagctcaaagcaaagagaaaacaatggcaaaaatgattgccggcggtctgacggaaaaagtggttttggagcagacaaaacaattttacttctttnnngccgacaatattccaccaccggtcattatggtccaacatgtctctttccgctataataaagattcgccattgatttaccgagatttggactttggcattgatttggatactcgagtggctttggtcggaccaaatggagccggaaaatcgacgcttctcaaattgttggcctccgatattgaaccaacggatggaatgattcgannnnnnnnnnnnnnnnnnnnnnnnnnnnnnnnnnnncatttggtggaagaattgcctttggaattgagtgcactggaatatatgcaacgagaatttccggatgttcgagagaaggaagaaatgcgcaaaatcattggtcgatacggcctttcgggacgagaacaaatttgtccaatgaaacaattgtcggatgggcaacgatgtcgagtcgcatttgcatggcttgcttggcaacaacctcatcttcttcttttggatgaaccaacgaatcatttggacatggaaagcatcgacgcattggccgaagcaatcaacaatttcgctggtggaatgattttggtttcccacgacttccgacttgtccaacaagtgaccgaggaannntgggtttgcgaccgtcaaacaatcacaaaatgggatggcgacattttctcctataaggcacatttgcgaaggaaaattgaggaagaggaccgcaaaaagnnnnnnnnnnnnnnnnnnnnnnnnnnn

SEQ ID NO: 884 - DNA, 2139 bp, Artificial Sequence
  Description of Artificial Sequence: Synthetic polynucleotide
  modified_base (1)..(615): a, c, t, g, unknown or other
  modified_base (678)..(678): a, c, t, g, unknown or other
  modified_base (721)..(723): a, c, t, g, unknown or other
  modified_base (817)..(1026): a, c, t, g, unknown or other
  modified_base (1258)..(2139): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatacgggttggttggccgaaatggaattggcaaaaccactttgctgaaaatgatatccagnaaacaattgattattccatcgaatattacatttttgagtgttnnncaggaggtggagggcgatgacacgccggtcattgatgcggttttggcatcggataaaaatcgagaaagattgctgagggaagagaaggaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcccgtgcactgttcattaaaccggatttattattgcttgatgaaccaacaaacatgttggacatgagagcagtttattggttggagaatcatttgcaagaatgggatgggacaatcctcaccgtttcgcatgatcgaaaattcctcaacacagtttgtacggatgttattcatttgcattcgagaaggctggatgcatacaaaggaaattatgacaattatgataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 885 - DNA, 1710 bp, Artificial Sequence
  Description of Artificial Sequence: Synthetic polynucleotide
  modified_base (1)..(177): a, c, t, g, unknown or other
  modified_base (442)..(444): a, c, t, g, unknown or other
  modified_base (607)..(609): a, c, t, g, unknown or other
  modified_base (660)..(660): a, c, t, g, unknown or other
  modified_base (895)..(1062): a, c, t, g, unknown or other
  modified_base (1219)..(1710): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtttctgctgctcgtaaatcatttcatcgatgggcttatgaatttacggcaaaggaaagaagtacaattttgaataaatggtttgaaattatgaaaatcaaggaagaacaattggccgaattgctcacaaaagaacaggggaaaacactcgccgaatccagagcagaaatccaatattctgcctcattttttgaatggtttggaggcgaagccagacgaatttatggccaaattgttccaccttcaaactgaataggcacannntttacatgtgctgagccaattggagttgtggccgtcataacgccgtggaatttccctagtgcaatgatttgccgtaaagttggtgcggcattggcagccggctgcacagttgtggtgaaaccggcagaggacaccccactttcggcattggctttagcagaannntctcaagaagcgggaataccaaatggagttttcaatataattccagcggtncgtgaacaaacagcagaaatttccaaatttatttgcgaatccgttgatgtcgattgcatttcattcaccggaagttcggcagttggaaagattcttttgagtcaatccgcatcgaccgtgaaaagggtttgtcttgaattgggcggaaatgccccgtttattgtttttaaatcggcggatttggacaaagctgttcagggggcaattgcgtcaaaatttcgttgttctggcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtcaaagatgctttggacaaaaaagtggaattaatttgtggcggagaagttttgcccgaaacaacaatttataagccaacaatattgaacaaagttaatggcgaaatggaaattgcaaatacagaaatatttggcccagtgattgccatacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 886 - DNA, 2907 bp, Artificial Sequence
  Description of Artificial Sequence: Synthetic polynucleotide
  modified_base (1)..(348): a, c, t, g, unknown or other
  modified_base (459)..(459): a, c, t, g, unknown or other
  modified_base (672)..(672): a, c, t, g, unknown or other
  modified_base (808)..(808): a, c, t, g, unknown or other
  modified_base (810)..(812): a, c, t, g, unknown or other
  modified_base (814)..(814): a, c, t, g, unknown or other
  modified_base (816)..(816): a, c, t, g, unknown or other
  modified_base (822)..(822): a, c, t, g, unknown or other
  modified_base (825)..(825): a, c, t, g, unknown or other
  modified_base (870)..(870): a, c, t, g, unknown or other
  modified_base (873)..(873): a, c, t, g, unknown or other
  modified_base (876)..(876): a, c, t, g, unknown or other
  modified_base (904)..(904): a, c, t, g, unknown or other
  modified_base (918)..(919): a, c, t, g, unknown or other
  modified_base (921)..(921): a, c, t, g, unknown or other
  modified_base (931)..(1029): a, c, t, g, unknown or other
  modified_base (1080)..(1080): a, c, t, g, unknown or other
  modified_base (1086)..(1086): a, c, t, g, unknown or other
  modified_base (1092)..(1092): a, c, t, g, unknown or other
  modified_base (1174)..(1174): a, c, t, g, unknown or other
  modified_base (1198)..(1198): a, c, t, g, unknown or other
  modified_base (1204)..(1204): a, c, t, g, unknown or other
  modified_base (1206)..(1206): a, c, t, g, unknown or other
  modified_base (1218)..(1218): a, c, t, g, unknown or other
  modified_base (1471)..(2070): a, c, t, g, unknown or other
  modified_base (2181)..(2181): a, c, t, g, unknown or other
  modified_base (2500)..(2907): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcctgggaatttctaacaaaatggctccaaattccatcggatcgtctctatgtttcatattttggaggtgatgaatcttcaggtctaaagccagacgaagaatgcagncaaatttggctttcacttggcgtcagtgaacgcactattttgccatttggaatgaaggacaatttttgggaaatgggagacactggtccatgtggtccctgctcagaaattcattacgaccgcattggggacagagatgcttcgaatttggtgaatgccgacgatccgatggttgtggaaatttggaatcttgttttcattcaatataacagngaggaaggcgggcagctcagatcattgccaaataaacacattgactgtggtttgggctttgaacgattggtggccgttgttcaacaaaaaacatcaaattatgacaccgacctatttacgcctatttttcagaaantnnntnanggaacnggnattcgagaatacactggaaaaattggtgcagaggatgttgatggngtnganatggcctatcgagttgtggccgatcatntacggacattgacnntngcattgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatttttcgcctccttggtgccggttgtcattgatattttgggaaatacnttcacngaattncaaaaagaccctcaaacaataatggaaataatcaatgaagaagaaacacaatttttgaaaacattaaaaagaggccaaattntgtttgaaaaagctgtgaaaactntaccancnggagttcaaacncttcctggtcaaattgcatggcgcctttatgacacttatggattcccattggatttgacccaattaatggctgaagagaaaggattgaccattcaaatggaagaatacgaggaaagcaggaaaaaggccattgaaatttcatcatttggagctgccaaaatgaatgatgctttgaatttggatgttcacacattagcagaattacaaaaattgggcattcaaagcacagatgattcaccaaaatatatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatccggatccagttcgtgttgtggcaattggagtgcccatcgaaaagttgttagaagaaccaaaaagtgatttaggccaaaatacatcggttgaattctgggaggaacgncatttgcgaaatgcttcgcacattggacatttggtgatcacagcggaggaagcaattgccaaaggaattcgacgaattgttgccgtgaccggaccagaggcggaaaaagcattgcattcggccgatattttggacaaaaagattgaaaaattaactgaagaagccaaaaaagggctggaattggcaatgaatgaagagacggtgaaattattgggcaaatcattcatcgaatttgaagaggaattaaattgtcaattattgccatattggcgtcgagatgctctccgagaaaaggtcaaacaattgagaatgagtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 887 - DNA, 1107 bp, Artificial Sequence
  Description of Artificial Sequence: Synthetic polynucleotide
  modified_base (1)..(843): a, c, t, g, unknown or other
  modified_base (996)..(996): a, c, t, g, unknown or other
  modified_base (1087)..(1107): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattccattaatttgtgtgaaggatgttccgccggaggccaaagattccaacgtgaacagtgcattcgcaatgtttcgcaattttgacaaaaaggacaccgcggccgcggccaatgtccaattgaaaacgctgcatcagaacacaattgancaattgcgaattcacaccggacagccagggaatttgaccaaattttccacatgcggatcggatggcatcattgcactttgggatgttcagnnnnnnnnnnnnnnnnnnnnn

SEQ ID NO: 888 - DNA, 1029 bp, Artificial Sequence
  Description of Artificial Sequence: Synthetic polynucleotide
  modified_base (1)..(12): a, c, t, g, unknown or other
  modified_base (60)..(60): a, c, t, g, unknown or other
  modified_base (105)..(105): a, c, t, g, unknown or other
  modified_base (307)..(693): a, c, t, g, unknown or other
  modified_base (1006)..(1029): a, c, t, g, unknown or other
nnnnnnnnnnnnttggaatcaaatttgaagaatgtgattgaacaagccagcttaaaaggnattttcgttggtggaaaaggtggagttggcaaaacaacatgccgntgctctcttgctgttcaattggcaaaaaatcgtcgctctgtgcttatcatttccacggacccggcacacaatatttccgatgcattcaatcaaaaattttcaaaaactccaacaaaagtaaatggctttgagaatttattcgccatggaagtggatggcagtggattgggcgaaagcaattccttaaccattgtaccggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatgaccacatttgtttgcgtttgcattgccgaattcctgtcaatgtatgagaccgaaagattggttcaggaattaaccaaaaaggacattgatgtgcataatattgtggtcaatcaattgttattcccggatcgaaatgcggacggcacaattgcatgcaaaaaatgccaatcgagatacaacattcaacaaaaatatttggaacagatttgcgagctttacgaggattttcacatcacacaactcccattgctggaaaccgaagtccgtggccctcatatgattcgggaattcagcgaacgattggtannnnnnnnnnnnnnnnnnnnnnnn

SEQ ID NO: 889 - DNA, 624 bp, Artificial Sequence; identical to SEQ ID NO: 454
  Description of Artificial Sequence: Synthetic polynucleotide
  modified_base (1)..(309): a, c, t, g, unknown or other
  modified_base (424)..(624): a, c, t, g, unknown or other

SEQ ID NO: 890 - DNA, 1569 bp, Artificial Sequence
  Description of Artificial Sequence: Synthetic polynucleotide
  modified_base (1)..(87): a, c, t, g, unknown or other
  modified_base (103)..(103): a, c, t, g, unknown or other
  modified_base (105)..(105): a, c, t, g, unknown or other
  modified_base (109)..(109): a, c, t, g, unknown or other
  modified_base (111)..(112): a, c, t, g, unknown or other
  modified_base (120)..(120): a, c, t, g, unknown or other
  modified_base (124)..(124): a, c, t, g, unknown or other
  modified_base (129)..(129): a, c, t, g, unknown or other
  modified_base (139)..(144): a, c, t, g, unknown or other
  modified_base (148)..(148): a, c, t, g, unknown or other
  modified_base (150)..(150): a, c, t, g, unknown or other
  modified_base (152)..(152): a, c, t, g, unknown or other
  modified_base (156)..(157): a, c, t, g, unknown or other
  modified_base (159)..(160): a, c, t, g, unknown or other
  modified_base (162)..(162): a, c, t, g, unknown or other
  modified_base (164)..(166): a, c, t, g, unknown or other
  modified_base (168)..(169): a, c, t, g, unknown or other
  modified_base (171)..(171): a, c, t, g, unknown or other
  modified_base (173)..(174): a, c, t, g, unknown or other
  modified_base (180)..(180): a, c, t, g, unknown or other
  modified_base (183)..(187): a, c, t, g, unknown or other
  modified_base (189)..(190): a, c, t, g, unknown or other
  modified_base (192)..(195): a, c, t, g, unknown or other
  modified_base (197)..(197): a, c, t, g, unknown or other
  modified_base (199)..(200): a, c, t, g, unknown or other
  modified_base (202)..(205): a, c, t, g, unknown or other
  modified_base (207)..(207): a, c, t, g, unknown or other
  modified_base (210)..(210): a, c, t, g, unknown or other
  modified_base (213)..(216): a, c, t, g, unknown or other
  modified_base (220)..(220): a, c, t, g, unknown or other
  modified_base (222)..(222): a, c, t, g, unknown or other
  modified_base (408)..(408): a, c, t, g, unknown or other
  modified_base (415)..(417): a, c, t, g, unknown or other
  modified_base (506)..(507): a, c, t, g, unknown or other
  modified_base (512)..(513): a, c, t, g, unknown or other
  modified_base (516)..(517): a, c, t, g, unknown or other
  modified_base (520)..(520): a, c, t, g, unknown or other
  modified_base (522)..(523): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (546)..(546): a, c, t, g, unknown or other
  modified_base (669)..(669): a, c, t, g, unknown or other
  modified_base (672)..(672): a, c, t, g, unknown or other
  modified_base (674)..(675): a, c, t, g, unknown or other
  modified_base (679)..(679): a, c, t, g, unknown or other
  modified_base (681)..(684): a, c, t, g, unknown or other
  modified_base (687)..(689): a, c, t, g, unknown or other
  modified_base (696)..(700): a, c, t, g, unknown or other
  modified_base (702)..(702): a, c, t, g, unknown or other
  modified_base (708)..(708): a, c, t, g, unknown or other
  modified_base (711)..(714): a, c, t, g, unknown or other
  modified_base (717)..(719): a, c, t, g, unknown or other
  modified_base (723)..(723): a, c, t, g, unknown or other
  modified_base (727)..(727): a, c, t, g, unknown or other
  modified_base (729)..(732): a, c, t, g, unknown or other
  modified_base (736)..(739): a, c, t, g, unknown or other
  modified_base (744)..(748): a, c, t, g, unknown or other
  modified_base (750)..(750): a, c, t, g, unknown or other
  modified_base (752)..(752): a, c, t, g, unknown or other
  modified_base (754)..(754): a, c, t, g, unknown or other
  modified_base (756)..(756): a, c, t, g, unknown or other
  modified_base (759)..(759): a, c, t, g, unknown or other
  modified_base (762)..(762): a, c, t, g, unknown or other
  modified_base (767)..(767): a, c, t, g, unknown or other
  modified_base (772)..(772): a, c, t, g, unknown or other
  modified_base (774)..(777): a, c, t, g, unknown or other
  modified_base (780)..(784): a, c, t, g, unknown or other
  modified_base (789)..(789): a, c, t, g, unknown or other
  modified_base (792)..(792): a, c, t, g, unknown or other
  modified_base (795)..(798): a, c, t, g, unknown or other
  modified_base (801)..(801): a, c, t, g, unknown or other
  modified_base (808)..(808): a, c, t, g, unknown or other
  modified_base (811)..(811): a, c, t, g, unknown or other
  modified_base (816)..(816): a, c, t, g, unknown or other
  modified_base (819)..(820): a, c, t, g, unknown or other
  modified_base (825)..(825): a, c, t, g, unknown or other
  modified_base (828)..(829): a, c, t, g, unknown or other
  modified_base (831)..(831): a, c, t, g, unknown or other
  modified_base (839)..(839): a, c, t, g, unknown or other
  modified_base (841)..(844): a, c, t, g, unknown or other
  modified_base (846)..(846): a, c, t, g, unknown or other
  modified_base (849)..(849): a, c, t, g, unknown or other
  modified_base (851)..(853): a, c, t, g, unknown or other
  modified_base (855)..(859): a, c, t, g, unknown or other
  modified_base (864)..(864): a, c, t, g, unknown or other
  modified_base (867)..(868): a, c, t, g, unknown or other
  modified_base (870)..(870): a, c, t, g, unknown or other
  modified_base (873)..(874): a, c, t, g, unknown or other
  modified_base (876)..(877): a, c, t, g, unknown or other
  modified_base (879)..(879): a, c, t, g, unknown or other
  modified_base (882)..(882): a, c, t, g, unknown or other
  modified_base (886)..(886): a, c, t, g, unknown or other
  modified_base (888)..(888): a, c, t, g, unknown or other
  modified_base (891)..(892): a, c, t, g, unknown or other
  modified_base (894)..(898): a, c, t, g, unknown or other
  modified_base (900)..(901): a, c, t, g, unknown or other
  modified_base (903)..(908): a, c, t, g, unknown or other
  modified_base (910)..(911): a, c, t, g, unknown or other
  modified_base (913)..(913): a, c, t, g, unknown or other
  modified_base (915)..(915): a, c, t, g, unknown or other
  modified_base (918)..(919): a, c, t, g, unknown or other
  modified_base (922)..(927): a, c, t, g, unknown or other
  modified_base (930)..(930): a, c, t, g, unknown or other
  modified_base (934)..(939): a, c, t, g, unknown or other
  modified_base (942)..(942): a, c, t, g, unknown or other
  modified_base (944)..(944): a, c, t, g, unknown or other
  modified_base (946)..(946): a, c, t, g, unknown or other
  modified_base (948)..(948): a, c, t, g, unknown or other
  modified_base (950)..(950): a, c, t, g, unknown or other
  modified_base (952)..(965): a, c, t, g, unknown or other
  modified_base (967)..(969): a, c, t, g, unknown or other
  modified_base (972)..(973): a, c, t, g, unknown or other
  modified_base (978)..(978): a, c, t, g, unknown or other
  modified_base (980)..(981): a, c, t, g, unknown or other
  modified_base (987)..(991): a, c, t, g, unknown or other
  modified_base (993)..(993): a, c, t, g, unknown or other
  modified_base (996)..(997): a, c, t, g, unknown or other
  modified_base (999)..(999): a, c, t, g, unknown or other
  modified_base (1001)..(1002): a, c, t, g, unknown or other
  modified_base (1005)..(1011): a, c, t, g, unknown or other
  modified_base (1013)..(1014): a, c, t, g, unknown or other
  modified_base (1017)..(1017): a, c, t, g, unknown or other
  modified_base (1019)..(1020): a, c, t, g, unknown or other
  modified_base (1023)..(1026): a, c, t, g, unknown or other
  modified_base (1029)..(1029): a, c, t, g, unknown or other
  modified_base (1031)..(1036): a, c, t, g, unknown or other
  modified_base (1038)..(1038): a, c, t, g, unknown or other
  modified_base (1041)..(1045): a, c, t, g, unknown or other
  modified_base (1047)..(1047): a, c, t, g, unknown or other
  modified_base (1049)..(1050): a, c, t, g, unknown or other
  modified_base (1053)..(1054): a, c, t, g, unknown or other
  modified_base (1056)..(1056): a, c, t, g, unknown or other
  modified_base (1059)..(1062): a, c, t, g, unknown or other
  modified_base (1065)..(1065): a, c, t, g, unknown or other
  modified_base (1069)..(1071): a, c, t, g, unknown or other
  modified_base (1074)..(1074): a, c, t, g, unknown or other
  modified_base (1077)..(1077): a, c, t, g, unknown or other
  modified_base (1080)..(1080): a, c, t, g, unknown or other
  modified_base (1083)..(1083): a, c, t, g, unknown or other
  modified_base (1085)..(1087): a, c, t, g, unknown or other
  modified_base (1089)..(1089): a, c, t, g, unknown or other
  modified_base (1092)..(1095): a, c, t, g, unknown or other
  modified_base (1098)..(1098): a, c, t, g, unknown or other
  modified_base (1102)..(1102): a, c, t, g, unknown or other
  modified_base (1105)..(1106): a, c, t, g, unknown or other
  modified_base (1108)..(1110): a, c, t, g, unknown or other
  modified_base (1112)..(1116): a, c, t, g, unknown or other
  modified_base (1118)..(1120): a, c, t, g, unknown or other
  modified_base (1126)..(1126): a, c, t, g, unknown or other
  modified_base (1128)..(1132): a, c, t, g, unknown or other
  modified_base (1134)..(1135): a, c, t, g, unknown or other
  modified_base (1137)..(1137): a, c, t, g, unknown or other
  modified_base (1139)..(1139): a, c, t, g, unknown or other
  modified_base (1143)..(1147): a, c, t, g, unknown or other
  modified_base (1149)..(1150): a, c, t, g, unknown or other
  modified_base (1153)..(1154): a, c, t, g, unknown or other
  modified_base (1156)..(1156): a, c, t, g, unknown or other
  modified_base (1159)..(1159): a, c, t, g, unknown or other
  modified_base (1161)..(1161): a, c, t, g, unknown or other
  modified_base (1163)..(1163): a, c, t, g, unknown or other
  modified_base (1165)..(1166): a, c, t, g, unknown or other
  modified_base (1168)..(1171): a, c, t, g, unknown or other
  modified_base (1174)..(1175): a, c, t, g, unknown or other
  modified_base (1180)..(1180): a, c, t, g, unknown or other
  modified_base (1182)..(1182): a, c, t, g, unknown or other
  modified_base (1184)..(1185): a, c, t, g, unknown or other
  modified_base (1189)..(1192): a, c, t, g, unknown or other
  modified_base (1194)..(1195): a, c, t, g, unknown or other
  modified_base (1197)..(1197): a, c, t, g, unknown or other
  modified_base (1206)..(1207): a, c, t, g, unknown or other
  modified_base (1209)..(1209): a, c, t, g, unknown or other
  modified_base (1214)..(1215): a, c, t, g, unknown or other
  modified_base (1218)..(1218): a, c, t, g, unknown or other
  modified_base (1220)..(1222): a, c, t, g, unknown or other
  modified_base (1224)..(1224): a, c, t, g, unknown or other
  modified_base (1227)..(1227): a, c, t, g, unknown or other
  modified_base (1230)..(1230): a, c, t, g, unknown or other
  modified_base (1234)..(1234): a, c, t, g, unknown or other
  modified_base (1236)..(1236): a, c, t, g, unknown or other
  modified_base (1239)..(1240): a, c, t, g, unknown or other
  modified_base (1242)..(1242): a, c, t, g, unknown or other
  modified_base (1246)..(1248): a, c, t, g, unknown or other
  modified_base (1251)..(1251): a, c, t, g, unknown or other
  modified_base (1256)..(1262): a, c, t, g, unknown or other
  modified_base (1266)..(1270): a, c, t, g, unknown or other
  modified_base (1272)..(1272): a, c, t, g, unknown or other
  modified_base (1274)..(1278): a, c, t, g, unknown or other
  modified_base (1280)..(1282): a, c, t, g, unknown or other
  modified_base (1287)..(1287): a, c, t, g, unknown or other
  modified_base (1290)..(1296): a, c, t, g, unknown or other
  modified_base (1298)..(1299): a, c, t, g, unknown or other
  modified_base (1301)..(1301): a, c, t, g, unknown or other
  modified_base (1304)..(1308): a, c, t, g, unknown or other
  modified_base (1314)..(1314): a, c, t, g, unknown or other
  modified_base (1317)..(1319): a, c, t, g, unknown or other
  modified_base (1322)..(1323): a, c, t, g, unknown or other
  modified_base (1326)..(1326): a, c, t, g, unknown or other
  modified_base (1329)..(1329): a, c, t, g, unknown or other
  modified_base (1332)..(1332): a, c, t, g, unknown or other
  modified_base (1338)..(1338): a, c, t, g, unknown or other
  modified_base (1342)..(1342): a, c, t, g, unknown or other
  modified_base (1345)..(1345): a, c, t, g, unknown or other
  modified_base (1347)..(1350): a, c, t, g, unknown or other
  modified_base (1354)..(1362): a, c, t, g, unknown or other
  modified_base (1365)..(1367): a, c, t, g, unknown or other
  modified_base (1369)..(1370): a, c, t, g, unknown or other
  modified_base (1372)..(1377): a, c, t, g, unknown or other
  modified_base (1380)..(1383): a, c, t, g, unknown or other
  modified_base (1386)..(1389): a, c, t, g, unknown or other
  modified_base (1395)..(1396): a, c, t, g, unknown or other
  modified_base (1400)..(1404): a, c, t, g, unknown or other
  modified_base (1482)..(1482): a, c, t, g, unknown or other
  modified_base (1561)..(1569): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnntttgaattgccccacntntttntnntttttggngcancgggngatttggccnnnnnnaagntntntccnncnntntnnngnntntnncgtganggnnnnntnncnnnngncnntnnnntnatnggnnnngccngntccaatttaaatgtgccaaaattgcgagaacaattcgaaaaacattgcaaagtgcgccaggatgaccgggacaaattcgaacagttcatccgccattgctcctacattaagggacaatatgacacggatgagggattgattgaattgaatacggccatcatggaaatggagggagaattcaaaagnccggctnnnaatcgaattttctatttggcattaccaccggaagttttccaacccgtgacggaatatattcaacgacattgtatgagcaccgatgaggnntgganncgnntgntnnttgagaagccnttnggntatganctgccatcggccgagaagctgaatgaacagattcgcgaggtgtttaaggaagaggaagtctatcggattgatcactacctgggcaaggaaatggtgcaaaatatcgaagtgatccgcttcggnaangnnttcntnnnnccnnnctggaannnnnancacatngcnnnngtnnngatnacantnnnngagnnnnttggnnnnnangngngnggnggntattntgacnannnnggnnnnntccgnganatnnnncanaatcatntgntgcanatnntgacnatnntngcgatggnannnncnagncnnntnnnnncgganganntncgnnannanaangtgnangtnntnnnnncnntnnnnnnanntngnatnnagnnnnnngtnacannnnnntangngncnantnnnnnnnnnnnnnntnnnganncaaanannggctannnnnangannananngtnnnnnnngnntcnannacnnnnacntnnnnnncngcnnnnntntnngtnnanaannnncgntggnnnggngtnccnttntnnntncgnnnnggnaaangtnngnnngnnnnnannncggaantnnnnntnnantncaannnnntnncgnncnacntntncnnannnnatnngctgnancnnaatnnnntnntnattcgggtnnanccganngangnnntntanatnaaantnaanncnaaannnccnggctnnnnnnncgannnnnancnnnnngnnntgganttnnnnnnnanntncannnnnactggnatnnnctnnccngangcntatgancgantgntnnnngatnnnnnnnnnggnnncnnannnnnnttnnnncgnnnngatganntggnnnnngcatggcgaattttcacacctttgctgaagaaaattgaaaatgaacgaattcagccggaacaatacatttatggaagncgtggtccggaaagcagtgatttgctgatgaagaagcatggttttgtgttcaccggcacttatcgatggaatccgccgnnnnnnnnn

SEQ ID NO: 891 - DNA, 1008 bp, Artificial Sequence
  Description of Artificial Sequence: Synthetic polynucleotide
  modified_base (1)..(126): a, c, t, g, unknown or other
  modified_base (292)..(411): a, c, t, g, unknown or other
  modified_base (691)..(1008): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgaatatgttatggctgaatatctaagaatgagtggaatgtactggtgcttagcagctctggatgttttgaatgaaactgaagaagctgacaagaatttcatcatacaatatattgaaaacaacaaacgtcttgatggtggatttgctccagcagaaggccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttttccggtgacgtggcaggcgaaatcgatactcgcttttcattttgtgcaattgcaacattacattttcttggacgccttgatgccatagatgtggttaaagcaattgaatttataaggaattgttacaattttgacggtggttttggtacaagaccgggctctgaaagccatgctggacaggtgtattgttgccttggagtcttagcaatatgtgatagtttagatttggtaaatgtcgaaagaacagcagaatggttggcagaaagacaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 892 - DNA, 606 bp, Artificial Sequence; identical to SEQ ID NO: 463
  Description of Artificial Sequence: Synthetic polynucleotide
  modified_base (1)..(432): a, c, t, g, unknown or other
  modified_base (604)..(606): a, c, t, g, unknown or other

SEQ ID NO: 893 - DNA, 939 bp, Artificial Sequence
  Description of Artificial Sequence: Synthetic polynucleotide
  modified_base (1)..(723): a, c, t, g, unknown or other
  modified_base (904)..(939): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgaatttattacagtgaaggccaaaagagcgcaaagaataagaatgactacattgtggaccattcaattataatgtatttaatcgatccagaaggacaattccaagaccattacggccaaaatagacgtccaagggaaattgtgaatgcaattcgcggccgaattctcaattgggagnnnnnnnnnnnnnnnnnnnnnnnnnnnnnnnnnnnn

SEQ ID NO: 894 - DNA, 1266 bp, Artificial Sequence
  Description of Artificial Sequence: Synthetic polynucleotide
  modified_base (1)..(258): a, c, t, g, unknown or other
  modified_base (366)..(366): a, c, t, g, unknown or other
  modified_base (436)..(1266): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatccggcatccgtgcctccgacgttgatgcagtggctgtctcaaatcgaccaggaattgtggtttcattgagagttggcatcaattatgcgctcagttttgccagntccattcgtcgacccctcatccttgtccaccatatgcgtgcccatgcccttacaatgcgactgttcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 895 - DNA, 1101 bp, Artificial Sequence
  Description of Artificial Sequence: Synthetic polynucleotide
  modified_base (1)..(582): a, c, t, g, unknown or other
  modified_base (724)..(984): a, c, t, g, unknown or other
  modified_base (1081)..(1101): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtactcctcctccttcatcgacttggccatttggaatttgtcattgtactcgagactcgaccctacaatcaaggatcacgattgactgcctacgaattgcaacaaagcggtgtgccctttcgactgattccggacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattgcccagtctggaatccagcattcgatattacgccgggcgcacttatttccggcttcttgacggaatgcggcaactttaaggccgaacaacttnnnnnnnnnnnnnnnnnnnnn

SEQ ID NO: 896 - DNA, 1059 bp, Artificial Sequence
  Description of Artificial Sequence: Synthetic polynucleotide
  modified_base (1)..(9): a, c, t, g, unknown or other
  modified_base (28)..(31): a, c, t, g, unknown or other
  modified_base (34)..(47): a, c, t, g, unknown or other
  modified_base (49)..(54): a, c, t, g, unknown or other
  modified_base (56)..(59): a, c, t, g, unknown or other
  modified_base (62)..(71): a, c, t, g, unknown or other
  modified_base (75)..(75): a, c, t, g, unknown or other
  modified_base (77)..(79): a, c, t, g, unknown or other
  modified_base (82)..(82): a, c, t, g, unknown or other
  modified_base (87)..(87): a, c, t, g, unknown or other
  modified_base (91)..(91): a, c, t, g, unknown or other
  modified_base (93)..(93): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (115)..(115): a, c, t, g, unknown or other
  modified_base (123)..(123): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (142)..(142): a, c, t, g, unknown or other
  modified_base (144)..(144): a, c, t, g, unknown or other
  modified_base (156)..(156): a, c, t, g, unknown or other
  modified_base (158)..(159): a, c, t, g, unknown or other
  modified_base (162)..(164): a, c, t, g, unknown or other
  modified_base (168)..(168): a, c, t, g, unknown or other
  modified_base (172)..(172): a, c, t, g, unknown or other
  modified_base (176)..(176): a, c, t, g, unknown or other
  modified_base (184)..(186): a, c, t, g, unknown or other
  modified_base (190)..(190): a, c, t, g, unknown or other
  modified_base (192)..(193): a, c, t, g, unknown or other
  modified_base (195)..(197): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (219)..(220): a, c, t, g, unknown or other
  modified_base (222)..(223): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (247)..(247): a, c, t, g, unknown or other
  modified_base (253)..(253): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (278)..(279): a, c, t, g, unknown or other
  modified_base (281)..(282): a, c, t, g, unknown or other
  modified_base (285)..(286): a, c, t, g, unknown or other
  modified_base (288)..(288): a, c, t, g, unknown or other
  modified_base (300)..(300): a, c, t, g, unknown or other
  modified_base (306)..(306): a, c, t, g, unknown or other
  modified_base (311)..(313): a, c, t, g, unknown or other
  modified_base (315)..(318): a, c, t, g, unknown or other
  modified_base (324)..(325): a, c, t, g, unknown or other
  modified_base (327)..(327): a, c, t, g, unknown or other
  modified_base (330)..(331): a, c, t, g, unknown or other
  modified_base (333)..(333): a, c, t, g, unknown or other
  modified_base (336)..(336): a, c, t, g, unknown or other
  modified_base (448)..(450): a, c, t, g, unknown or other
  modified_base (531)..(531): a, c, t, g, unknown or other
  modified_base (567)..(567): a, c, t, g, unknown or other
  modified_base (957)..(957): a, c, t, g, unknown or other
  modified_base (1057)..(1059): a, c, t, g, unknown or other
nnnnnnnnncaacaatgcggattggcannnnccnnnnnnnnnnnnnntnnnnnnannnnatnnnnnnnnnnattnannnttngggangcantnaancaggcaatngangaggaantggaacgngangatcgngtnttnttgntnggcgaagaagtngnncannntganggancttncaaggtannnaaangnntnnngaanaaatatggngancancgnntnntngacacnccnatnacngaaatgngctttncnggnttngcngtnggngccgcntnngnnggnntnaggccaatttgngaattnatgannntnnnntttgcnntncanncnatngaccaattaataaacagcgctggcaaaacattttacatgtccgctggaagggtcccagttccaatcgtttttcgcggtccaaatggagccgcagccggcgtggccgcccaannnagccaagattatgcggcatggtatgcgcactgtcctggcctaaaagtaatttctccgtacaattctgaggacgcaaaaganttactgaaggcggcaattcgtgatgaaaatccattnattttcctcgaaaatgaattgctctatggcacccaattcccggtcagcgaagaagtgctgagccccgattttgtgcttccaattggcaaagcaaaagtggaaatggccggccaacattgtacattggtttcgcattcaaaaggcgtccaaatttgtattgaggccgccgaacaattgaaagcgattggaattgaggccgaggtgatcaatttgcgaactcttcgcccattggactttggcacggttgaacaatccgtccgcaaaacccatcatttggtcacggtggagactggatggccattctgcggaattggcgccgaattatccgctcaaatttccgaatccgaaacattcgactatttggatgcacccgtcctccgagtcacaggngtggatgtgccaatgccttatgcagcaacactggaggcggccgcattgccttccacaacagatgtggtcaggacggtgaagaaaagtttgaatatcgctnnn

SEQ ID NO: 897 - DNA, 1113 bp, Artificial Sequence
  Description of Artificial Sequence: Synthetic polynucleotide
  modified_base (1)..(135): a, c, t, g, unknown or other
  modified_base (306)..(306): a, c, t, g, unknown or other
  modified_base (580)..(621): a, c, t, g, unknown or other
  modified_base (922)..(924): a, c, t, g, unknown or other
  modified_base (961)..(1113): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatattagtacatttggccccgatgacaacccaaatgggatggtttgcgaatcatcatttgcgacactttttccaagatatcgagagaaatatattcgcgaagtatggccactggttcaaaaagcacttaatgaacataatgtgaagggcgatttggatgtgttggaaganacaatgactgtgcgaacaacccgaaaaacatgggacccttttattttgtacaaagcaagagacctgatcaaattgttggctaggagtgtacaaatcgaacaagctcgtcgagtattagaggatcaaattttctctgatatcatcaaaatttcttcattggttccaaaccgagaacgttttgtgaagcgacggctacggctggttggtcaaaatggtgcgacattgaaagcaattgaattgctcaccgaatgctatgttcaaattcaagttggannnnnnnnnnnnnnnnnnnnnnnnnnnnnnnnnnnnnnnnnnaggaatattgtggaggattgtatgcgaaatattcatccaatttatcatatcaaaactttgatgatcaaaagagaattgatgaaggatgaaaaattgaggaatgaaaattgggaaagatttctgcctaaattccaaaagaaggtccaaacagcaaaagaagttcgcgaattgaagaagaaagcgaaggcaaaatggaaaccgaaaaaagaatatagtccattcccaccggcccaacatcaacagaaagtagatttgcaattggaaagtggcgaatatttcctcaatgaacgaaacaggaagnnnaaacaaaaacgagcggaagttgaagccaaacaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 898 - DNA, 444 bp, Artificial Sequence
  Description of Artificial Sequence: Synthetic polynucleotide
  modified_base (247)..(444): a, c, t, g, unknown or other
atgtccctcgctacaaaattgcgtcgaatgaggaaaaagccaccagaaggttgggaactaattgaaccgaccttggaagaatttgaagcgaagatgcgtgaggcagaaactgaaccacatgaaggaaaacgtcgaacggagacagtctggccagtattccggatccaccatcaacgctctcgatacatttataatttgcattacaaagaagaaaaaatctcacgcgaattgtaccaattttgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 899 - DNA, 1512 bp, Artificial Sequence
  Description of Artificial Sequence: Synthetic polynucleotide
  modified_base (1)..(207): a, c, t, g, unknown or other
  modified_base (298)..(1512): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttatcaaaagccaccaatgtttggtgattttgaggcacaaaggcattggatggaattgaccgtaaatttgcccgcatttcaatggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 900 - DNA, 1128 bp, Artificial Sequence
  Description of Artificial Sequence: Synthetic polynucleotide
  modified_base (1)..(615): a, c, t, g, unknown or other
  modified_base (658)..(663): a, c, t, g, unknown or other
  modified_base (793)..(1128): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgaaaattgcggaaggcaaaacgtgcatattttgcaacnnnnnnagttcaaagtttttaacgattgatgcactccaaaaacatatgcgagacaaaaatcattgtgcctttcgaattgatgaagaagcaattgtggaattcatggacttttatgattatagcgatatgtatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 901 - DNA, 2112 bp, Artificial Sequence
  Description of Artificial Sequence: Synthetic polynucleotide
  modified_base (1)..(465): a, c, t, g, unknown or other
  modified_base (543)..(543): a, c, t, g, unknown or other
  modified_base (682)..(1188): a, c, t, g, unknown or other
  modified_base (1353)..(1353): a, c, t, g, unknown or other
  modified_base (1360)..(1362): a, c, t, g, unknown or other
  modified_base (1507)..(1545): a, c, t, g, unknown or other
  modified_base (1605)..(1605): a, c, t, g, unknown or other
  modified_base (1710)..(1710): a, c, t, g, unknown or other
  modified_base (1876)..(2112): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacagtgccttttggaaatggattcatccaatcgaaggatggtgtcaaaattggttttgagatgtgcgaagaaatntggacagcgcattcgccaagcaatgaattggctttgcagggagtggaaattatttgcaatccaagtggcagccatcatgttttgggaaaatcaaacacaagaataaatcgattggtgcttgggacaacttcaaaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgatccagcctatttctttgagggcaaacttgcaccaaccgacccaaatgaactttgccgccgggttcttttcacctgctatatgggctcaaaaaattcatcagaaatgacacggacattggccgccggtttagccgaggatatcaatgcaaatcattcaaanattttcnnnagcattttaatcgataaaatcaacgacgcctttttggatacactcaaattccagccaaattttgattcagcggatagccgtgaggggatggcattgcaaaatttgcaggcccgttctcgcatggttttggcctatttgcatgcannnnnnnnnnnnnnnnnnnnnnnnnnnnnnnnnnnnnnncttgtccttggcacttcgaatgtggatgaaagtttggttggctatgtcacaaaatatatntgttcttcggctgatttgaatccaataggcgccgtttcaaaaagtgatcttcgcgaatttttacgatttatcaataaaacgcacaatttccgacatttgcaaagnataatcgattctgtgccaaccgccgaattaaaaccattgaagaatggcgaaattgtgcaaacggatgaagcagaaattggcctgacatacgacgagctctcaatattcggacgacttcgtaggccaggttgctctggtccgttggcaatgttcattgaattggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 902 - DNA, 1905 bp, Artificial Sequence
  Description of Artificial Sequence: Synthetic polynucleotide
  modified_base (1)..(1053): a, c, t, g, unknown or other
  modified_base (1195)..(1602): a, c, t, g, unknown or other
  modified_base (1765)..(1905): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcttcatctcttcctccactcatttaatgtgttatccgccgttttgaatgctcaaatgccggccaattctcgatgccgaattattcatgaattcaatcaaggacggtggccatttttgatcgcttccgaatgcaatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccggatgaccgaaatccgtgaggaaatccttcaatcgcggcgattggattcatattttgcgaaaaatccccgagagcggtggatgctggaacaggacaggaaaaagtttaaattgaatgtgcacagtcccggcattgctgatgtcccgattacattggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 903 - DNA, 852 bp, Artificial Sequence
  Description of Artificial Sequence: Synthetic polynucleotide
  modified_base (1)..(273): a, c, t, g, unknown or other
  modified_base (520)..(852): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccaaaaaaataatgaggttgacggcgatttacttcaattggatatgggcggcggccttccattccgggctggcgttttcgatggtgccattagtgtttcagccatacaatggctctgtcattccaattcaaagaaggaagatccacggaagcgattgctcaaattcttcgaatcacttttcgcttgtttgtctcgttcggcacgtgccgttttccaattttatccagaaaatcagaaacaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 904 - DNA, 1023 bp, Artificial Sequence
  Description of Artificial Sequence: Synthetic polynucleotide
  modified_base (1)..(12): a, c, t, g, unknown or other
  modified_base (151)..(624): a, c, t, g, unknown or other
  modified_base (760)..(762): a, c, t, g, unknown or other
  modified_base (825)..(825): a, c, t, g, unknown or other
  modified_base (838)..(843): a, c, t, g, unknown or other
  modified_base (979)..(1023): a, c, t, g, unknown or other
nnnnnnnnnnnnattggaactcatgatggaaaattccactgcgatgaaatttttgcttgctatatgctcaaaaaattaccgaagtttgcggattacaaaattctgaggacaagagacccgaaaatacttgagaaatgctcaataattgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaaaggcacatccaagtggacgtattttgatttttcagcaaggagggatgccgtggaaaactcatttttttgaattggaagaagagatgaaattgcaggatgagcgaatttgtcttgtggttttcaaggacnnnacaaatggaagttggcgtgtccaggccattccagtctcggagacaagcggatttgaaaatagnattttgctccctnnnnnntggaaaggttatcgagaaaaggaattggaagaacaatccggcatttctggagcaattttcgtgcatatttccggttttattggaggagttaaaacgaaagaaggcgcattgaaaatggccgagaagacattggaannnnnnnnnnnnnnnnnnnnnnnnnnnnnnnnnnnnnnnnnnnnn

SEQ ID NO: 905 - DNA, 2916 bp, Artificial Sequence
  Description of Artificial Sequence: Synthetic polynucleotide
  modified_base (1)..(840): a, c, t, g, unknown or other
  modified_base (1015)..(1116): a, c, t, g, unknown or other
  modified_base (1332)..(1338): a, c, t, g, unknown or other
  modified_base (1340)..(1340): a, c, t, g, unknown or other
  modified_base (1344)..(1344): a, c, t, g, unknown or other
  modified_base (1597)..(1872): a, c, t, g, unknown or other
  modified_base (2011)..(2604): a, c, t, g, unknown or other
  modified_base (2714)..(2715): a, c, t, g, unknown or other
  modified_base (2718)..(2718): a, c, t, g, unknown or other
  modified_base (2727)..(2727): a, c, t, g, unknown or other
  modified_base (2734)..(2734): a, c, t, g, unknown or other
  modified_base (2736)..(2736): a, c, t, g, unknown or other
  modified_base (2739)..(2739): a, c, t, g, unknown or other
  modified_base (2741)..(2742): a, c, t, g, unknown or other
  modified_base (2745)..(2745): a, c, t, g, unknown or other
  modified_base (2748)..(2748): a, c, t, g, unknown or other
  modified_base (2751)..(2751): a, c, t, g, unknown or other
  modified_base (2754)..(2754): a, c, t, g, unknown or other
  modified_base (2757)..(2757): a, c, t, g, unknown or other
  modified_base (2763)..(2764): a, c, t, g, unknown or other
  modified_base (2766)..(2766): a, c, t, g, unknown or other
  modified_base (2911)..(2916): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggatcaattgtgtcaaccgttcgggacattgtgggcttgagcaatttgatagcaacccacatatgcttgttgatgcaaccggaacagaattttgcggataatccaattcaactttgcgattttgttgggatgatttcgcaaaatgctgaactcgaagatttaacaaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaagaaagtgcatgaacagcatcacaaattcatgttgaatgagcagttgaaggcaatcaaaaaggagctgggcatagagaaagaggacaaacaagcagtgctggagaaattggatgaacggctgaaggagctgaaagtgccggaatatgcgatgaaagtgatcaaagaggaacaggctaaactgtcattcctcgatccgcacagcagcgaattnnnnnnntncagnaattatttggactggttgaccaacattccatggggaaaaacatctgaagaaatgaaggatgttcactgggcacgaaaagttttggacgaagaccactacggaatgaaggatgtgaaggaacggattctggaatttatcgccgttggaatactcaaacaacaaacaaatggcaagattttatgcttttatgggccacccggagtgggaaagaccagcattgccaaatcaattgcccgggcgttgaacagacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatctgtacagcaaatgtgatcgatcggataccgggcccattgaaggatcgaatggaaatgatcgaagtttcgggatatgtggctgaggagaagatggaaattgccaaaaaatatttaatccccaaatgccaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggattcattccaaaggatggtccatctttcggtgctgcaattgcgagtgcaataatttcacgagtcctaaagaagccggcaaaagaaggattcgcaatgactggggnnatntcattgacnggaaaantnctncnnatnggnggngtnaangagaanntnattgcggcaaaaagggctggcgttaatcgagtgattttgccggaggagaataagaaggattttgatgatttggatgaattcattcggcaggacatcactgtgcactttgtgtccgaatatgaccaaatatttcaattacttttcnnnnnn

SEQ ID NO: 906 - DNA, 1374 bp, Artificial Sequence
  Description of Artificial Sequence: Synthetic polynucleotide
  modified_base (1)..(87): a, c, t, g, unknown or other
  modified_base (303)..(304): a, c, t, g, unknown or other
  modified_base (306)..(306): a, c, t, g, unknown or other
  modified_base (309)..(310): a, c, t, g, unknown or other
  modified_base (315)..(317): a, c, t, g, unknown or other
  modified_base (319)..(319): a, c, t, g, unknown or other
  modified_base (321)..(321): a, c, t, g, unknown or other
  modified_base (328)..(328): a, c, t, g, unknown or other
  modified_base (330)..(330): a, c, t, g, unknown or other
  modified_base (333)..(334): a, c, t, g, unknown or other
  modified_base (340)..(345): a, c, t, g, unknown or other
  modified_base (454)..(456): a, c, t, g, unknown or other
  modified_base (474)..(474): a, c, t, g, unknown or other
  modified_base (480)..(480): a, c, t, g, unknown or other
  modified_base (483)..(489): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(504): a, c, t, g, unknown or other
  modified_base (507)..(512): a, c, t, g, unknown or other
  modified_base (518)..(518): a, c, t, g, unknown or other
  modified_base (520)..(522): a, c, t, g, unknown or other
  modified_base (527)..(528): a, c, t, g, unknown or other
  modified_base (531)..(532): a, c, t, g, unknown or other
  modified_base (534)..(534): a, c, t, g, unknown or other
  modified_base (537)..(538): a, c, t, g, unknown or other
  modified_base (540)..(543): a, c, t, g, unknown or other
  modified_base (549)..(550): a, c, t, g, unknown or other
  modified_base (595)..(1167): a, c, t, g, unknown or other
  modified_base (1366)..(1374): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnactgttacaattttacttggtgctcaatggggcgatgaaggaaaagggaaagtgttggattttttgattggccatcagcaggttgatgttgttgcccgttgccaaggtggaaacaacgccggccacacggttgttgcaaataaacaggaatatgacttccacttgcttccatccggaatggcttccgaaaattgcttaaatgtcattgggaatggnntngtnntcaannngnangcacttntngannaaattnnnnnnaattatattcatgataacggatttacaacgaaaaacctgtccattagtgagcgtgcacatatcatcctgccttatcatatggttctggatgcactggaggaagagagtnnnaaaggaccgaacaaaatnggtacnacnnnnnnnggnatnggnccnnnntannnnnncaaatntnnncggannggnntncgnntnnnngatctnntgaatgatccggttaattttgaaaagaaagtaaattacttaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaactcctcaagattgggaccgaataaaagtggaatacaaaacttttcccggctggaaggcggaaacaacgaaggcaaggaaatacgaggatttgcccgctgcttgcaaagaatatttggaatttctggaaaacgaactgaaagtgcctataaaattcattggcgttggaaaggaccgagaagcattgattttccgtnnnnnnnnn

SEQ ID NO: 907 - DNA, 552 bp, Artificial Sequence; identical to SEQ ID NO: 587
  Description of Artificial Sequence: Synthetic polynucleotide
  modified_base (154)..(387): a, c, t, g, unknown or other
  modified_base (445)..(445): a, c, t, g, unknown or other
  modified_base (454)..(454): a, c, t, g, unknown or other
  modified_base (462)..(462): a, c, t, g, unknown or other
  modified_base (474)..(474): a, c, t, g, unknown or other
  modified_base (531)..(531): a, c, t, g, unknown or other
  modified_base (550)..(552): a, c, t, g, unknown or other

SEQ ID NO: 908 - DNA, 813 bp, Artificial Sequence
  Description of Artificial Sequence: Synthetic polynucleotide
  modified_base (1)..(3): a, c, t, g, unknown or other
  modified_base (151)..(186): a, c, t, g, unknown or other
  modified_base (216)..(216): a, c, t, g, unknown or other
  modified_base (379)..(381): a, c, t, g, unknown or other
  modified_base (486)..(486): a, c, t, g, unknown or other
  modified_base (571)..(573): a, c, t, g, unknown or other
  modified_base (772)..(813): a, c, t, g, unknown or other
nnnagcgaattaagatttgattcgagtttggatctgatgcgacgtttgcctcctcaaaactgcgaaaaacatttgaccgatttggttgcattggccccagatttgtgcgaatcattgctcacgaccgtggatcaaccattgaaagttgctnnnnnnnnnnnnnnnnnnnnnnnnnnnnnnnnnnnngattacaaccgggatggcgacagttacagntcgccttggacaaatgcctatgatcctccactcgaagatggagttgtgccatctgatagacttcgcaaattggaaatcgaagtaaatgcagcatttgaagcctatcgagacatgtattttgaaggcggtgtttccagtgtttatttttgggatatcgacagtnnnggttttgccggtgttgtgctgctgaaaaaggagacggacggtagcaaaggggtcaaaggctgctgggactcaattcatgtgctggaagtgaatgagaaaacgaancatgccaaatacaaattgacgagcacggtgatgctttggcttcaaaccaatccggccacaactggcacaatgaatttgggcggtnnnttgacccgacaaacggagcaggattgtgttgtgaacgagcagaatccacatttggcaaatattggaaaaatgattgaggatcaagagaacaaaatgcgtgccacattgaatgaggtctattttggcaaagctcgacaaattgttggcgatcttcgctcggtggaaagcactacggaattgaagagtcgtggcgaaatannnnnnnnnnnnnnnnnnnnnnnnnnnnnnnnnnnnnnnnnn

SEQ ID NO: 909 - DNA, 1590 bp, Artificial Sequence
  Description of Artificial Sequence: Synthetic polynucleotide
  modified_base (1)..(6): a, c, t, g, unknown or other
  modified_base (160)..(171): a, c, t, g, unknown or other
  modified_base (249)..(249): a, c, t, g, unknown or other
  modified_base (438)..(438): a, c, t, g, unknown or other
  modified_base (877)..(879): a, c, t, g, unknown or other
  modified_base (991)..(1152): a, c, t, g, unknown or other
  modified_base (1417)..(1590): a, c, t, g, unknown or other
nnnnnncctgtccgtattctgaagaatatggcccaagaagagcggggtgaaactgccagattgtcatcatttgttggggcaactgcaattggagatttggtgaagacaacgcttggcccaaaagggatggataaaattttgataagtggctcgggagagnnnnnnnnnnnngtgcaagttaccaatgatggggcaacaattttaaagtcaattggtgtcgataatcccgcagcaaaggttttagttgtnatttcgctcacacaggacaaagaagttggagatggcacaacatctgtgacggtttttgccgcagaattattaaaagaggcagaaacaatgattggacagagaattcatccacaattaatcatttctggttatcgaaaagcattaactgtggccaaaaattcacttgagaaggctgcacattcttctggngagaatttgcgtgaagatttaatgaaaattgcgaaaacctcgcttggatccaaaattctttcccaacattccgagcatttttccaacttggcagtggatgctgttcttcgacttggcgaacaagcctcacttgactcaatccaaataatcaaaaaattgggcggatcaatggaagattcatatttggaggagggttttttgctcgaaaagaagccaggaatgtaccagccacaaaaaattgaagacgccaaaattctgatcgccaatacaccaatggacacggacaaaatcaaagtttttgggagtcgcattaaagtcgattccattgctaaagttgccgaattggaacaagcagagaaggacaaaatgaaggaaaaggtcgaaaagatttgtgcccacggcgtcaatgtgttcatcaatcggcaactcatttacaatnnnccggaacaaatatttgcggacaagaaggttatggccattgagcatgccgactttgaaggaattgaacgacttgctttggttttgggcggagaaatcgtttcgacatttgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgatgccctctgtgttttgtccactcacgtcaaagacaaaagagttgttccgggtgctggggcttccgaaattttgatggccaccgcagtgatggccgaaagtcaaaaagtgcccggaaaagagtcactcgccatggaagcatattcccgtgcccttgccaaacttccgacaataatttgcgataatgctggcctggacagtgccgaaattatttcccatattcgtgcggaacatgcaaaaggcaatcataaatttggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 910 - DNA, 1623 bp, Artificial Sequence; identical to SEQ ID NO: 439
  Description of Artificial Sequence: Synthetic polynucleotide
  modified_base (1)..(195): a, c, t, g, unknown or other
  modified_base (244)..(246): a, c, t, g, unknown or other
  modified_base (322)..(324): a, c, t, g, unknown or other
  modified_base (378)..(378): a, c, t, g, unknown or other
  modified_base (523)..(681): a, c, t, g, unknown or other
  modified_base (742)..(744): a, c, t, g, unknown or other
  modified_base (823)..(825): a, c, t, g, unknown or other
  modified_base (918)..(918): a, c, t, g, unknown or other
  modified_base (1102)..(1104): a, c, t, g, unknown or other
  modified_base (1273)..(1344): a, c, t, g, unknown or other
  modified_base (1621)..(1623): a, c, t, g, unknown or other

SEQ ID NO: 911 - DNA, 1629 bp, Artificial Sequence
  Description of Artificial Sequence: Synthetic polynucleotide
  modified_base (1)..(9): a, c, t, g, unknown or other
  modified_base (241)..(249): a, c, t, g, unknown or other
  modified_base (336)..(336): a, c, t, g, unknown or other
  modified_base (439)..(588): a, c, t, g, unknown or other
  modified_base (865)..(868): a, c, t, g, unknown or other
  modified_base (870)..(870): a, c, t, g, unknown or other
  modified_base (873)..(873): a, c, t, g, unknown or other
  modified_base (1615)..(1629): a, c, t, g, unknown or other
nnnnnnnnnagcggcaggtcaattatatttgatgagtcaggtcaaccatttattgtgattcgggagcaggaaaggcaaaaacgactaactggaatcgaggcacttaagagtcatatattggcagcaaaacaagtggccaacactctgaaaacttctcttggacccacgggccttgataaaatgttggttagtcctgatggggaagtcacaatcacaaatgatggcgcaacgataatgaagnnnnnnnnngtggatcatcatgttgcaaaattgatggtcgaactttcccaatcacaggatgatgaaattggtgatggaacgacaggtgtagtttgnttggccggtgctttgatggaacaagccgagtcattgttggataagggaattcatcctaccaaaattgctgacggatttgaaatggcttgcaaaaaagcattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatggaacaacgcgatgtgaattttgagttgatcaaaataattggaaagcccggtggccaaatgcaagatactgccctggtcaaaggagttgttatcgacaaaacattgagtcacccacaaatgcctcgacgaatggagaatgccaaaatagccatacttacttgcccattcgagccaccaaaacccaagactaagcataaattggatatcagttcaacggatgagtacaaacagctgcagaaatatgaacgagatacatttgaaaagatgattnnnnangtnaaagcaagcggtgcaaccttggcaatttgtcaatggggattcgatgatgaggccaatcacttgcttttacatcacaatttgcccgccgtacgctgggttggcggtccggaaattgagttagttgccattgccaccaatggacggattgtgcctcgttttgccgaattgactccagaaaagttgggcaccgccggactcgtccatgaactcaaatttggcactgacaatgatcaaatgctttgcatcgaacaatgcccaaatacccgggcgatcacggttctcatccggggtggaaataaaatggtaatcgaggaaacgaaacgttcgttgcacgatgcattctgcgtggttcggaacctgattcgtgacaataaaatcgtctatggcggtggggcagccgaattagcttgctcaattgccgttgcccaagaagcggataaggttgagggaattgagcaatacgcattccgagcattcgccgatgcccttgagagtattccggcggcattggctgagaattccggcctgcctccaattgacactttgaccgaattaaaggccaaacaaatccaggagggcaaacctttcttgggcgtggattgcttgctgaaaggcacaaatgatatgaaggcgcagggcgtcatcgaaactgtgctctccaaacgtgagcaaatttcactggcaactcaagtggtccgaatgattcttaagattgacgatgttcgagtgcctgatgatgaannnnnnnnnnnnnnn

SEQ ID NO: 912 - DNA, 1620 bp, Artificial Sequence
  Description of Artificial Sequence: Synthetic polynucleotide
  modified_base (138)..(138): a, c, t, g, unknown or other
  modified_base (322)..(552): a, c, t, g, unknown or other
  modified_base (726)..(726): a, c, t, g, unknown or other
  modified_base (1021)..(1077): a, c, t, g, unknown or other
  modified_base (1227)..(1227): a, c, t, g, unknown or other
  modified_base (1285)..(1311): a, c, t, g, unknown or other
  modified_base (1612)..(1620): a, c, t, g, unknown or other
atggcttcaattgcctgtcttaatcccaaagctgaacttgcccgtcatgctgctgctcttgaaatgaacatcagtggagctagaggccttcaagaagttatgaaaacaaatttgggcccaaaagggacactgaaaatncttgtgtcaggttccggcgacttgaaagtgaccaaggacggcaatgttcttttgcatgaaatgcaaatccaacatcccactgcttcattgattgcaaaagcttgtacagcacaaaatgacgcaaccggggatggcacaacttcgactgtacttttgatcggtgaactgcttaagcaagccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccctgatttgcatatgatcgaaattatgcaaatggaacatgaaatggagtcggacaccaaattgattcgcgggcttgtgcttgaccatggaggccgtcatccggatatgccaaaaaatcttgaaaatgcctacattctcagttgcaatgtttcattagaattcgagaaagcngaagtcaattccggccttttctataaaaccgcagccgagcgcgagaatttgctgcaagctgagagggaatatattactcgacgagtgatgaaaattatcgaattgaagaaacaagtttgcgattccgaatcagacgggaaaaaattcaattttgtggtcatcaaccaaaagggaattgatccgccatcactggatttgttcgcccaaaatggaattatggcattaaggcgtgccaaacgtcggaacatggaacgtcttcaattggcatgtggaggcgaggcggtcaattcggtgnnnnnnnnnnnnnnnnnnnnnnnnnnnnnnnnnnnnnnnnnnnnnnnnnnnnnnnnnggcgaagacaaatacacattcatcgagggctgtaaaaaaccaaaatcggtcacacttttgctgaaaggaccaaataaacatacaattggccaaatcaaagatgcaatttatgatggaattcgagccgtgttcaatgtgctcaaagatgcngccgttgttcccggtgcaggcgcattcgaaattgccggctattgcacattgaaaaagnnnnnnnnnnnnnnnnnnnnnnnnnnncaaattgggcgttttggccttgccaatgcacttctcataatcccaaaaacattggccattaacagcggccatgatgcacaagatgtgatcgtcaaattggtggaggcctataatgcaggcaccggcgaaacggccgttggtctggatttggtcagtggcgaggcatcaactcttcagggtatttgggacaatgttcgtgtgaagcaggcatcattggccgcttgccacagcattgccagcaatttgcttgaagtggacgaagtgatgagggccggaatgcgcgatttgaaaggagcccaannnnnnnnn

SEQ ID NO: 913 - DNA, 1608 bp, Artificial Sequence
  Description of Artificial Sequence: Synthetic polynucleotide
  modified_base (1)..(3): a, c, t, g, unknown or other
  modified_base (129)..(129): a, c, t, g, unknown or other
  modified_base (162)..(162): a, c, t, g, unknown or other
  modified_base (238)..(288): a, c, t, g, unknown or other
  modified_base (604)..(606): a, c, t, g, unknown or other
  modified_base (697)..(699): a, c, t, g, unknown or other
  modified_base (913)..(1134): a, c, t, g, unknown or other
  modified_base (1324)..(1324): a, c, t, g, unknown or other
  modified_base (1492)..(1608): a, c, t, g, unknown or other
nnnatgtcggtcccaataattttgttgaaagaaggtactcaaacgaaacaaggacgcggccaaatcttgagcaacattagtgcatgctgtgcagtcgctgacagtgttcgaaccactctcggaccaagnggtctggacaagcttctggtcgatcgaaaagancaaacaacaatttcaaacgatggcgcaacaattttgaagcaattggacattgtttatccggccgctgtggtaatgnnnnnnnnnnnnnnnnnnnnnnnnnnnnnnnnnnnnnnnnnnnnnnnnnnngtggttgttttggctgccgaatttttgaaatccaccaagccattcattgaggaaggggtcagccctcaattgatcatcaaagcactgaatttggcatcgcaagaggcattaaaaaagctccgagaattgtctgtcaaaatcaccggcaacaacgaatgtcatgatatgctaatccgctgtgcctcgacaactttgagcagcaaattggctaaaacaagaacaacatcattttgcgaaatggtggtggatgcggtcagctaccttgacatcgatttgcccctgaacatgattggaataaagaaagttggcggtggcnnncttcaggattctcaattggtcaagggagtggccttcaagaaagcgttcagctatgccggcttcgagatgcaaccaaaacactacaaaaacnnnccaattgccattctcaacatcgaattggagctgaaagcggaaaaggacaatgccgagctgcgcattgggaatgtggccgattaccaggaagtagtgaatgcggaatggaccatcctctaccaaaaactggagaaaatccatgcaagtggagccaaaattgtcctctcaaaattgccaattggcgatgtggccactcaatggtttgcggacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatcgccgaaaccgagcgttccctccatgatgccataatgattgtccgtcgcgccatgaagaatgacacaattgttgccggcggcggtgccattgaaatggaattgtccaaacatttgttggagctggccaataaccgtgaaatgaaggaccaattcttttggaagggctatgcaaaggcttttgagnttattccacaacaactctgccagaatgccggactcgacgcaatcgccattttgggtgaactacgctctgcccatttgaaaggacaaaaatgggctggaattgacattcaaaaggaatgtgtagccgacaatatggaaggatgcatttgggagccaactttagtcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 914 - DNA, 5046 bp, Artificial Sequence
  Description of Artificial Sequence: Synthetic polynucleotide
  modified_base (1)..(783): a, c, t, g, unknown or other
  modified_base (970)..(1434): a, c, t, g, unknown or other
  modified_base (1504)..(1506): a, c, t, g, unknown or other
  modified_base (1564)..(1566): a, c, t, g, unknown or other
  modified_base (1654)..(1722): a, c, t, g, unknown or other
  modified_base (1951)..(1951): a, c, t, g, unknown or other
  modified_base (2101)..(2103): a, c, t, g, unknown or other
  modified_base (2206)..(2370): a, c, t, g, unknown or other
  modified_base (2962)..(3573): a, c, t, g, unknown or other
  modified_base (3769)..(3769): a, c, t, g, unknown or other
  modified_base (3771)..(3771): a, c, t, g, unknown or other
  modified_base (3774)..(3774): a, c, t, g, unknown or other
  modified_base (3913)..(3915): a, c, t, g, unknown or other
  modified_base (3979)..(3981): a, c, t, g, unknown or other
  modified_base (4228)..(4230): a, c, t, g, unknown or other
  modified_base (4332)..(4332): a, c, t, g, unknown or other
  modified_base (4600)..(5046): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaggcatcagcaaaacatggtatactgtacatgatcaccaaatatggttatgtgttcatctttgacatcgagacgggattgaccatttacacggtgcgaatttccaccaacaccgtgttcatcagcaccgaatacactccgaccaatggcattgtggggatcaaccgaagtggacaggttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggaaatgtgccccataaagttgtgcaatgctttgccgaaatgggacaattcgacaaaatcattttgnnngccaaaaaggtcaactatgagccggactatttgttccaaatgagacaagtgttgcgcnnnacacatccggacaatgcctcgactttcgctcaaatgcttgtcaatgagggaccaaatggagagcctttggccgatatcaatcaggttnnnnnnnnnnnnnnnnnnnnnnnnnnnnnnnnnnnnnnnnnnnnnnnnnnnnnnnnnnnnnnnnnnnnngacaacgaatcgcaaggtcttctgcaaacacgattgctggaaatgaatttgatttcgaatccgaaagtggcggatgcaatcctcggcaacaaaatgttcagtcattatgatcgtgccacaattggtcaactctgtgagaaagccggcctcctccagcgtgcactggaacatttcacggacctttatgacattaaacgaacagttgtgcacacacagcatttcaatccgnagtggttggtcaacttttttggccgattgaatgtgcaagattcactggaatgcttgaaagcaatgttgcaagccaatcttcgtcaaaatctccaaattgttgtgcaaattgcctcaaaatattgtgaacagctgacaacccaagcactcnnngacctctttgaatcattcaaaagttatgaaggattattctatttcctcggttccattgtgaacttcagccaagatcctgaagttcatttcaaatatattcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctatttgtatcgcagcaatttgatgaaatccattgaggtgtttgtgagcaaagtcaatccaaaacgtctgcccattgtcattggcgcactgcttgatgtggattgcagcgaggatacaatcaagcaactcattcaaaacaccaaaggcaaatttgacattgatgagctggtggaggaggtggagaaacgcaatcggctgaaattgttgagcgcctggctggagaatcgagtgcatgaaggaaatcaggatcaggctacgcacaatgccctagccaaaatctacatcgattccaacaacaatccggaacgttatctacgcgagaatcaattctatgatccaaaagtgattgggaaatattgcgaaaaacgtgatcctcactatgccctggttgcctatgaacgcggacgttgcgatgatgagctgatttcggtttgcaatgagaattcactgttcaaaaatttggcccgctacctggtccgacgccgtgacaatgagctttgggccaccgtacttgccgaagaaaatcaatatcgacgccagctcatcgatcaagttgttcagacggcattgaccgaaacgctggatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgccgagcccaaccatgctcaagttcaacaagttggcgatcgatgcactgaacagggaatgaatgatgcggcccgaattctcttcaactccattagcaactatgctcggctggcaacaaccctggtggagttgggcgacttccctggggcagtggatgcagcgaggaaggcaaattccactaagacatggaaanangtntgttttgcctgtgtgagccatcaagaatttcgtctggcccaaatttgtggcctccatattgttgtccacgctgatgagctcgaagaattgatcaattattaccaaaatcgtggccatttcaacgagctgattgcattgnnngaagctgctttgggcctggaacgagcccatatgggaatgttcacggagttggccatcctctacnnnaaatttaaaccggagaaaatgcgtgaacatttggacctgttctggtcacgtgtgaatattccaaaagttttgcgagccgcagagcaagcccatctttggtcggagctggtcttcctctatgataaatatgaagaatatgacaatgctgttttgacaatgatccagcatcctactgaagcttggcgtgaacaacatttcaaggaaattgttacaaaggttgccaatgtggaattgtattacaaggcannncaattttatttggactataaaccgacattgctgaatgatcttttgatggtcctctcgcaacgtcttgaccaaacccgaacagttgcattcttccaaaaaccnaataatctcgccctggttcaaccctatcttcgccaagtgcaaaatttgaacaacaaggcactgaatgaatgcctcaatcaattgttcattgaggatgaagactatgagtcgctgaaggccagcatcgaaacatatgacaattttgacaatattgcactggcacagcagctggaaaatcatccactcgtagaattccgtcgaatctcagcctatctttacaagggaaataatcgttggaaacaatccgttgaactgtgcaaaaaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 915 - DNA, 858 bp, Artificial Sequence
  Description of Artificial Sequence: Synthetic polynucleotide
  modified_base (1)..(645): a, c, t, g, unknown or other
  modified_base (847)..(858): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttttacagctttcaaattattccagtgatgggccaaatttttgttggcgatttcaattcgtacaaatatttggtggaaagcatccggctttttccaaatcaacaaaaattttcgacaatgttgaaggaggccggattcgaaaatgttacctacgaagaattgactggcggaatttgcaatatttttatggccaaaaaannnnnnnnnnnn

SEQ ID NO: 916 - DNA, 1149 bp, Artificial Sequence; identical to SEQ ID NO: 615
  Description of Artificial Sequence: Synthetic polynucleotide
  modified_base (235)..(237): a, c, t, g, unknown or other
  modified_base (316)..(318): a, c, t, g, unknown or other
  modified_base (949)..(1149): a, c, t, g, unknown or other

SEQ ID NO: 917 - DNA, 858 bp, Artificial Sequence; identical to SEQ ID NO: 428
  Description of Artificial Sequence: Synthetic polynucleotide
  modified_base (1)..(171): a, c, t, g, unknown or other
  modified_base (382)..(858): a, c, t, g, unknown or other

SEQ ID NO: 918 - DNA, 1539 bp, Artificial Sequence
  Description of Artificial Sequence: Synthetic polynucleotide
  modified_base (1)..(285): a, c, t, g, unknown or other
  modified_base (520)..(522): a, c, t, g, unknown or other
  modified_base (625)..(651): a, c, t, g, unknown or other
  modified_base (766)..(1539): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccggcttttgtgaagctggggcaacttgcaagcacaagggcagatctattacctgaatcggtgattcgtgaattggtcaaattacaggatcaggttccgccgttctcgtcagagacggcacggggtattttggaacaggaattggatacaccgctggaagagatcttttcccggttcgaggataccccggtggccgcggccagtattggtcaggtgcatctgggcaaacttnnncagagcggagaggcggtagcgatcaaaatccagcgccccggcatatcgcggattgtgcagcgcgatctggatattctgcgagaactgactgcgatggcggagnnnnnnnnnnnnnnnnnnnnnnnnnnntggttggtgaatgagacgaaacaaaatttgccgaaagaattggattttttgcatgaggccggaaatgcggaaaaagcccgaaaaatgttcgaacatttgaaatttattagagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 919 - DNA, 342 bp, Artificial Sequence; identical to SEQ ID NO: 523
  Description of Artificial Sequence: Synthetic polynucleotide
  modified_base (1)..(9): a, c, t, g, unknown or other
  modified_base (21)..(21): a, c, t, g, unknown or other
  modified_base (33)..(33): a, c, t, g, unknown or other
  modified_base (41)..(42): a, c, t, g, unknown or other
  modified_base (60)..(60): a, c, t, g, unknown or other
  modified_base (64)..(66): a, c, t, g, unknown or other
  modified_base (68)..(68): a, c, t, g, unknown or other
  modified_base (105)..(105): a, c, t, g, unknown or other
  modified_base (111)..(111): a, c, t, g, unknown or other
  modified_base (120)..(120): a, c, t, g, unknown or other
  modified_base (126)..(127): a, c, t, g, unknown or other
  modified_base (136)..(136): a, c, t, g, unknown or other
  modified_base (138)..(139): a, c, t, g, unknown or other
  modified_base (153)..(153): a, c, t, g, unknown or other
  modified_base (159)..(159): a, c, t, g, unknown or other
  modified_base (165)..(165): a, c, t, g, unknown or other
  modified_base (211)..(216): a, c, t, g, unknown or other
  modified_base (258)..(258): a, c, t, g, unknown or other
  modified_base (268)..(268): a, c, t, g, unknown or other
  modified_base (273)..(273): a, c, t, g, unknown or other
  modified_base (291)..(291): a, c, t, g, unknown or other
  modified_base (327)..(327): a, c, t, g, unknown or other
  modified_base (340)..(342): a, c, t, g, unknown or other

SEQ ID NO: 920 - DNA, 555 bp, Artificial Sequence
  Description of Artificial Sequence: Synthetic polynucleotide
  modified_base (1)..(279): a, c, t, g, unknown or other
  modified_base (379)..(555): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggatgcggcaaattcagtgctgggcgagtgcaaaattgcagcggagaaacggctgaaacgcaagaattcccggctcgacaaatgcggaattcccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 921 - DNA, 1596 bp, Artificial Sequence
  Description of Artificial Sequence: Synthetic polynucleotide
  modified_base (1)..(399): a, c, t, g, unknown or other
  modified_base (577)..(792): a, c, t, g, unknown or other
  modified_base (1063)..(1188): a, c, t, g, unknown or other
  modified_base (1374)..(1374): a, c, t, g, unknown or other
  modified_base (1443)..(1443): a, c, t, g, unknown or other
  modified_base (1449)..(1449): a, c, t, g, unknown or other
  modified_base (1461)..(1461): a, c, t, g, unknown or other
  modified_base (1485)..(1485): a, c, t, g, unknown or other
  modified_base (1494)..(1494): a, c, t, g, unknown or other
  modified_base (1507)..(1596): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaatcgattgtggatgttttcggcactgtggccaaaacaccttcgcccgtttcgagttgcagccaaagtgatgtggaaattcgaatacaaaaattgttcatcgtttctgccgccgaaccccgacttcccctgcaaattgaggatgcttcacggccagagcaaaatcaggacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaggtcagctatttcaagggatcagcctatttggcccaatcgccgcaattgtacaaacaaatggccattgccggcgactttgaccgtgtgttcacggttggtgccgtttttcgtgccgaagacagtaacacccaccgacatttgaccgaatttgtgggacttgacctggaaatggccttcaaatttcattaccatgaggtgatgaacacaattgccgaaatgctcattgagctgttcaaaacactccaatcggaatattcaaccgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttgagcactccaaatgaaaaattgttgggccgaattgtgcgagaacgccatcaaaccgatttttacgtgctcgacaaattcccacttgccgttcgtccattctacacaatgccggatcccaaggatggcaaatactcgaacagctatgatatgttttatttaggtgaggaaatcctgtccggngcccaacgtgtccatgaccctgcacttttgacggaacgagcaaagttgcacaatattgatttggaaaanatcaangcctacgtggangcattcaaatatggctgcccaccncatgccggnggaggaattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 922 - DNA, 2559 bp, Artificial Sequence; identical to SEQ ID NO: 419
  Description of Artificial Sequence: Synthetic polynucleotide
  modified_base (220)..(249): a, c, t, g, unknown or other
  modified_base (438)..(438): a, c, t, g, unknown or other
  modified_base (1165)..(1182): a, c, t, g, unknown or other
  modified_base (1224)..(1224): a, c, t, g, unknown or other
  modified_base (1329)..(1329): a, c, t, g, unknown or other
  modified_base (1464)..(1464): a, c, t, g, unknown or other
  modified_base (1849)..(2361): a, c, t, g, unknown or other
  modified_base (2557)..(2559): a, c, t, g, unknown or other

SEQ ID NO: 923 - DNA, 771 bp, Artificial Sequence
  Description of Artificial Sequence: Synthetic polynucleotide
  modified_base (1)..(111): a, c, t, g, unknown or other
  modified_base (415)..(645): a, c, t, g, unknown or other
  modified_base (760)..(771): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatcaattaaaaattaaggtcatcaccaagtaccaagtgatcacaaaaagagtgcctcgcgttgtggccgaacggaagaagtggaaaaaatttggccaatgtgctggcgatgggcccggcccgaacatcaacacaacgtatgcatcggaaacggtggacatcaattttacaatcgattgggcgaacgacatccttttggacgacaaaaagggaatggcaaagggacaagccacaaagggagcgcattgtcgcctgtgcaaatcggatgaacattggagcatgcaatgtccatataaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaaggttttgccttcatcacattcgccactcgaaaggaggccgaaaatgccattcaacaattcaacggtgcccgattccagcatttgattttgaaggtggaatggaccaggnnnnnnnnnnnn

SEQ ID NO: 924 - DNA, 741 bp, Artificial Sequence; identical to SEQ ID NO: 616
  Description of Artificial Sequence: Synthetic polynucleotide
  modified_base (1)..(66): a, c, t, g, unknown or other
  modified_base (108)..(108): a, c, t, g, unknown or other
  modified_base (330)..(330): a, c, t, g, unknown or other
  modified_base (622)..(741): a, c, t, g, unknown or other

SEQ ID NO: 925 - DNA, 3246 bp, Artificial Sequence
  Description of Artificial Sequence: Synthetic polynucleotide
  modified_base (1)..(660): a, c, t, g, unknown or other
  modified_base (669)..(669): a, c, t, g, unknown or other
  modified_base (714)..(714): a, c, t, g, unknown or other
  modified_base (726)..(726): a, c, t, g, unknown or other
  modified_base (750)..(750): a, c, t, g, unknown or other
  modified_base (762)..(762): a, c, t, g, unknown or other
  modified_base (795)..(795): a, c, t, g, unknown or other
  modified_base (801)..(801): a, c, t, g, unknown or other
  modified_base (826)..(826): a, c, t, g, unknown or other
  modified_base (882)..(885): a, c, t, g, unknown or other
  modified_base (1156)..(1158): a, c, t, g, unknown or other
  modified_base (1405)..(1947): a, c, t, g, unknown or other
  modified_base (2101)..(2118): a, c, t, g, unknown or other
  modified_base (2323)..(2325): a, c, t, g, unknown or other
  modified_base (2415)..(2415): a, c, t, g, unknown or other
  modified_base (2421)..(2421): a, c, t, g, unknown or other
  modified_base (2454)..(2454): a, c, t, g, unknown or other
  modified_base (2464)..(2464): a, c, t, g, unknown or other
  modified_base (2472)..(2473): a, c, t, g, unknown or other
  modified_base (2475)..(2475): a, c, t, g, unknown or other
  modified_base (2587)..(2655): a, c, t, g, unknown or other
  modified_base (2860)..(3246): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcgtttnatggccgatttggacattgttggttgcggttggattgaatgcccngcaaataaatangaatatattcacccaaataagaanctgagcacatgncaaattgagttatcaataaatgttgccaatttnttggtncatgattcgagtcccgaatggtcgntggttgctccacttcgaacattgagttttgacattgaatgcatgggtccattaggnnnntttccggatgccagccgtgacccagtcatccaaatagccaatatggtcaaattggagggccaaacggaaccattcgtccggaattgtttcaccctgggaacatgtgaaccaatcgtcggttcggacatcattgaatgcgccactgagcaggaattactctcaaaatgggccgattttgtgcgacaaattgatccggacatcctcactggatataatattcaaaatttcgatttaccttatatcattgatcgggcgaaacaattaaaggttnnncgtgtctgctatttgagtagaataaagggaaatgtttgcaagcaaagggatgccagcctccaatccaagcaaatgggcaaccggatcaacaaaatttgctcaatggatggccgaattgtgtttgatgttcttcagattttacttcgcgattacaaattgagaagttattcgctgaacaatgttagctgttatttccttggtgaacaaaaggaggatattgcctacaattttataccagaattacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacaaatggtgttgaatggaaggcaattggcggtgaaagtgtcagccaattcggtttatggattcaccggagcatcacgcggcaaatcgccttgcgtggaagtttcccaatctgtcacatcgtttggccggcaaatgatcgaaatgacaaaannnnnnnnnnnnnnnnnntataaatttggcgcagtgaatggtctttgtccggaggatgccaaagttatttatggggacaccgactcagtgatgatcaaatttggggttaaaaccgtcgaacatgcaatggaattgggccggcatgcggccgcggaaattagcaaacgatttttgccgccaattcatttggaatttgagaagatctattttccatatttactannntcaacaaaaacgctatgccggctttattggacacgcccggagaaacacgataaaatggattgtaaagggttggaaacagtgcgaaggganaattgnccattggtggccagtgttttgaatgcttgcttngagaaattgntggttggnngngacaaggaaggagcattgaattatgcaaaagcggtcatttccgatttactctgcggtcgggtggacatttccatgttgaccatcacaaaggaattgaccaaaaagggcgagnnnnnnnnnnnnnnnnnnnnnnnnnnnnnnnnnnnnnnnnnnnnnnnnnnnnnnnnnnnnnnnnnnnnncctcgtctcggcgatcgagttccctatgtgattgtgaacaaaggggcaaatgtgccagcatatgaaaaggcggaagatccaatttgggtgctgaccaacaatgtcccaattgatacaacttattatttggaacatcaattggccaaaccattggcccgcatttttgaacccattttaggcattaaggccgaacaaattttaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 926 - DNA, 1212 bp, Artificial Sequence
  Description of Artificial Sequence: Synthetic polynucleotide
  modified_base (1)..(627): a, c, t, g, unknown or other
  modified_base (793)..(798): a, c, t, g, unknown or other
  modified_base (934)..(1212): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttgatacaggtcgtgacggatttgttatgggtgaaggtgccggaattctgattctggaatctctggaacatgctcaggctcgtggcgcacgaatctacggtgaagtaatcggttacggtctgacaggtgatgcacaccatatgacagaaccagatccagatnnnnnnggagcagcacgttgtatgacgatggcgcttcgcaatgcaggcattcagccggaagaagtggattacatcaatgcacacggaacttcgacaccagttggtgaccgttccgaaacgttagctatcaaaaaggcgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 927 - DNA, 1653 bp, Artificial Sequence
  Description of Artificial Sequence: Synthetic polynucleotide
  modified_base (1)..(855): a, c, t, g, unknown or other
  modified_base (886)..(897): a, c, t, g, unknown or other
  modified_base (1089)..(1089): a, c, t, g, unknown or other
  modified_base (1141)..(1143): a, c, t, g, unknown or other
  modified_base (1204)..(1653): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggggatgcggatcgactcatttattttnnnnnnnnnnnntacccaaatggaaatggcacaaaagtctcattgctcgacggggatcatatttcggcactttttgccaaattcatcaaacaacaattcaatgaagccaaacgaattggccaaccaattccactcacatttggaattgtgcaaaccgcctatgccaatgggaattcgacgcgatattttatggaaaaattgggntctcaaaccaaaattgacaaaaactgggtgaaacatttggaggaggaagcannnaaatttgacattggaatctattttgaggcaaatggccatgggacagtgtgctttgcgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 928 - DNA, 1491 bp, Artificial Sequence
  Description of Artificial Sequence: Synthetic polynucleotide
  modified_base (1)..(99): a, c, t, g, unknown or other
  modified_base (171)..(171): a, c, t, g, unknown or other
  modified_base (261)..(261): a, c, t, g, unknown or other
  modified_base (415)..(633): a, c, t, g, unknown or other
  modified_base (671)..(671): a, c, t, g, unknown or other
  modified_base (675)..(675): a, c, t, g, unknown or other
  modified_base (678)..(678): a, c, t, g, unknown or other
  modified_base (687)..(687): a, c, t, g, unknown or other
  modified_base (690)..(690): a, c, t, g, unknown or other
  modified_base (700)..(700): a, c, t, g, unknown or other
  modified_base (704)..(705): a, c, t, g, unknown or other
  modified_base (711)..(711): a, c, t, g, unknown or other
  modified_base (718)..(718): a, c, t, g, unknown or other
  modified_base (722)..(723): a, c, t, g, unknown or other
  modified_base (726)..(726): a, c, t, g, unknown or other
  modified_base (729)..(729): a, c, t, g, unknown or other
  modified_base (732)..(732): a, c, t, g, unknown or other
  modified_base (739)..(739): a, c, t, g, unknown or other
  modified_base (757)..(757): a, c, t, g, unknown or other
  modified_base (762)..(762): a, c, t, g, unknown or other
  modified_base (773)..(773): a, c, t, g, unknown or other
  modified_base (786)..(788): a, c, t, g, unknown or other
  modified_base (794)..(795): a, c, t, g, unknown or other
  modified_base (798)..(798): a, c, t, g, unknown or other
  modified_base (803)..(804): a, c, t, g, unknown or other
  modified_base (807)..(807): a, c, t, g, unknown or other
  modified_base (810)..(810): a, c, t, g, unknown or other
  modified_base (825)..(825): a, c, t, g, unknown or other
  modified_base (834)..(834): a, c, t, g, unknown or other
  modified_base (843)..(843): a, c, t, g, unknown or other
  modified_base (850)..(851): a, c, t, g, unknown or other
  modified_base (856)..(856): a, c, t, g, unknown or other
  modified_base (859)..(859): a, c, t, g, unknown or other
  modified_base (866)..(867): a, c, t, g, unknown or other
  modified_base (877)..(879): a, c, t, g, unknown or other
  modified_base (888)..(888): a, c, t, g, unknown or other
  modified_base (894)..(894): a, c, t, g, unknown or other
  modified_base (900)..(906): a, c, t, g, unknown or other
  modified_base (910)..(910): a, c, t, g, unknown or other
  modified_base (912)..(912): a, c, t, g, unknown or other
  modified_base (975)..(975): a, c, t, g, unknown or other
  modified_base (1158)..(1158): a, c, t, g, unknown or other
  modified_base (1294)..(1491): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtttgttcggcattgattgaatcggatgtgaatgttcgattggtgaaagaattgcgggaaagtgtcagnaaatcaattgattttgatgaaatggccggcggagtgaataaaaggcgactaatccaacgggcggtgttcaccgaattgttgaaattattngatcccggcgttttgccctatcaaccggttaaaggtcgaccaaatgtgataatgtttgttggattgcaaggggccggtaaaacgacaacatgtacaaaaatggcctattattatcagaaaaagggctggaagacaagtttggtttgtgcggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaacccggatgaagtattactcgttgtcgacagtangacnggncaggatgcngtnaatcaggcgnaacnnttcaangagaaanttgnngtnacnggngttgtantgaccaaactggatggcnatgcnaaaggtggtgntgcactgtctgtnnntgcggnnacnggttnnccnatnaagttcgttggtctnggggagaanattgatganctggagnnattcnatncggaacnntttgttcaannnattcttggnatgggngacatnnnnnnnttgntngaaaaagtatccgaaatgggattggaagacaatgaggaattgataaaaaggctgaaacaagancaattcactctgcgcgatatgtacgaacaattccagaatataatgaaaatgggaccatttggcaaattatggagtatgattcccggttttgggccagacttcctgtccaagggaaatgagcaagaatcaatgtcaaggctgaaaaaattgatgacaattatggactcaatggccgatggaganttggatcatccaaaggcaaatgaattgttcacgaaagaaccaagccggctgatcagagtggccaaaggcagtggaacatctgtcaatgaagtgaaggaattgatgtcccaatataagaaattcgcggatatggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 929 - DNA, 1209 bp, Artificial Sequence
  Description of Artificial Sequence: Synthetic polynucleotide
  modified_base (1)..(129): a, c, t, g, unknown or other
  modified_base (250)..(987): a, c, t, g, unknown or other
  modified_base (1120)..(1209): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgctggcttttcaatgccaggccaatacaacgaaatgccggtggcagattcggccaaacatactcgatccagtgtcagcctgttcgatgtttcccatatgcttcaggtctttttaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccatatgcccattgtgcatcgaatggacaaggcggcaattggcttcatcacatccggatgtccatccccctgtttgggcaaaaatattgcaatggcctatgtggacaaggattgcggcaaattgggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 930 - DNA, 1389 bp, Artificial Sequence
  Description of Artificial Sequence: Synthetic polynucleotide
  modified_base (1)..(222): a, c, t, g, unknown or other
  modified_base (438)..(438): a, c, t, g, unknown or other
  modified_base (508)..(1389): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaattttaagttggatccaaacaaaattggttttttggccgttggaactgaaacattgatcgacaggagtaaaagtgtcaaatcagtgctggttgaattgttcgcagaatcaacagagatctcgagggaattgacgaaagaatgcctgctttgggggaacacaagcattgtgcatgccgccgattggatatacgcaaattatgaatttgaagcnaaacttgctattgttgtttgtgttgatgtggcaatctatgaacaaggaccagcaagatgcaccggtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 931 - DNA, 462 bp, Artificial Sequence
  Description of Artificial Sequence: Synthetic polynucleotide
  modified_base (1)..(177): a, c, t, g, unknown or other
  modified_base (240)..(240): a, c, t, g, unknown or other
  modified_base (370)..(462): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcgccggacttgttgaatatatggcatccggaccaattgttgcaatggtttgggaaganttggatgctgtcaaacaaggccgtgttatgcttggcgcaacaaatccattggctagtgccccggggacaatccgtggaaattactgcgttgaaactggccgtaatatttgccatggatcggacagtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 932 - DNA, 999 bp, Artificial Sequence
  Description of Artificial Sequence: Synthetic polynucleotide
  modified_base (1)..(96): a, c, t, g, unknown or other
  modified_base (475)..(849): a, c, t, g, unknown or other
  modified_base (994)..(999): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaaacccattgacattgaatgcgattacagctgcaaagaaaattgggggtgatgttacactgcttttaaccgggaaaaattcggaaaatgtggcgaaatctgcagcaaaaataccaaatataaagaatattctattttcgcaaaaacccgaattggaagcaaatttgccggaaagagtttcttctgtgcttttggctgtacaaaaacaattcaaatttacacatatcctcgccagtgcttctacattcagtcggggggtcattcccagaactgcggcctttttggatgtttcaccaatttcggaaataaccgctgtacatggcgaggacacattctcaagaccaacttacgcgggaaatgcaatcgccaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaattcaacatttggccgggatgaaggacagcaaagtgattgtggccataaacaaggacaaggatgcacccatttttcaggtagccgattttggactggttgcggatttgttcaaagcagtcccggaaatgacggctcagctcnnnnnn

SEQ ID NO: 933 - DNA, 1743 bp, Artificial Sequence
  Description of Artificial Sequence: Synthetic polynucleotide
  modified_base (1)..(477): a, c, t, g, unknown or other
  modified_base (499)..(501): a, c, t, g, unknown or other
  modified_base (607)..(843): a, c, t, g, unknown or other
  modified_base (933)..(933): a, c, t, g, unknown or other
  modified_base (1024)..(1743): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcatttcgaacttgatttgnnncgctttggaccatatcgattggactacacacaaaatggacgttttatgttgttgggcggaaggaaaggacatgtggccgcattcgattggatgaccaaggaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtcgcctctttcccaactggccatggctgtctcgacattctcacccaaaatccagcaaatgccatcattttgagcggcgattcagcnggcattgtttctatgtggtcgcccaactccaaaaaaccccttgtcgaaatgcttgcccataaaggccctctacagggtattgctgtggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 934 - DNA, 1776 bp, Artificial Sequence
  Description of Artificial Sequence: Synthetic polynucleotide
  modified_base (1)..(351): a, c, t, g, unknown or other
  modified_base (672)..(672): a, c, t, g, unknown or other
  modified_base (1206)..(1206): a, c, t, g, unknown or other
  modified_base (1258)..(1509): a, c, t, g, unknown or other
  modified_base (1675)..(1776): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccaatcaatgtttgttggaaatgttgcaatatattctctcggtggatggattctattattctccctcaatggacatttctcattcacttcaatggctcagtgaaaattcaagtccagaattgcatcgaaaaccattaattgaaacggtcgaccaacgatttgtatggaatgtgaaattatgttcaaaattcaatacaccggagacagctctcaaaatttgtgcatccattaattcatggattgttggcattcgcctctgtacaattaataatattcaatttaaattggctattatttccagaagatcaaccgatagncccggagtccgattccacacaagaggggctgattcagagggaaattgtgcaaattttgttgaaaccgaacaaattgttgaatatgattttgatcattcacatggaaaatcaaattctcggcaaattgcttcatttattcagttgtggtctcaaaaacccaatttgaaatggcaaccggatccatcattcaaatcgattgatgaacagcacaattgctttcggatgcatttgaataatttatttgcccgctacggccgggaggcagtaattttgaatttgatcaatcattatggccgggaacataaaattggaatgcaactccgtgaagttattgacaaattgagcacacccagtgtaaaatatgtggcatttgattttcatcggcattgtcaatcgctgaattgggatcggctagcattgttgaaggatgagctgcagtcggatattcgtcaatttggcttcttttccactcgcctgcagcggaacaatcaagcatggtttgagagcggattcttccggacaaattgcatgtantgtttggatcggaccaatgtggtgcaggctcttttgggaatggaatcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgccatcaatttatttttgggtaattattcggtgaataattcgataattccggaacgtgttgatcattccttggttaattttgatgcaaatggagctgcaatagctggtgccgtattttccctggcaatgacctcattatgcattctggtttcgggttagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 935 - DNA, 3003 bp, Artificial Sequence; identical to SEQ ID NO: 549
  Description of Artificial Sequence: Synthetic polynucleotide
  modified_base (67)..(69): a, c, t, g, unknown or other
  modified_base (204)..(204): a, c, t, g, unknown or other
  modified_base (218)..(219): a, c, t, g, unknown or other
  modified_base (222)..(222): a, c, t, g, unknown or other
  modified_base (234)..(234): a, c, t, g, unknown or other
  modified_base (241)..(241): a, c, t, g, unknown or other
  modified_base (264)..(264): a, c, t, g, unknown or other
  modified_base (267)..(267): a, c, t, g, unknown or other
  modified_base (272)..(273): a, c, t, g, unknown or other
  modified_base (285)..(285): a, c, t, g, unknown or other
  modified_base (421)..(546): a, c, t, g, unknown or other
  modified_base (787)..(1347): a, c, t, g, unknown or other
  modified_base (1551)..(1551): a, c, t, g, unknown or other
  modified_base (1600)..(1878): a, c, t, g, unknown or other
  modified_base (1923)..(1923): a, c, t, g, unknown or other
  modified_base (1965)..(1965): a, c, t, g, unknown or other
  modified_base (1968)..(1968): a, c, t, g, unknown or other
  modified_base (1998)..(1998): a, c, t, g, unknown or other
  modified_base (2025)..(2025): a, c, t, g, unknown or other
  modified_base (2028)..(2028): a, c, t, g, unknown or other
  modified_base (2031)..(2031): a, c, t, g, unknown or other
  modified_base (2134)..(3003): a, c, t, g, unknown or other

SEQ ID NO: 936 - DNA, 1209 bp, Artificial Sequence
  Description of Artificial Sequence: Synthetic polynucleotide
  modified_base (1)..(309): a, c, t, g, unknown or other
  modified_base (430)..(525): a, c, t, g, unknown or other
  modified_base (661)..(1209): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaaaaagtggatgttgtcgcccataatttgttgttgacttccaaaaatgctttacaaattttttgtgattacgatgttgtggccgattgttcggataatgtggccacaaggtttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccctgctatcgttgcatttttccagagccaccaaagccggaaatggtgacaagttgttcggagggtggcgtccttggcccagtggttggcgtcattggaagtatgcaggcattggaaattatcaaaattgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 937 - DNA, 2109 bp, Artificial Sequence
  Description of Artificial Sequence: Synthetic polynucleotide
  modified_base (1)..(447): a, c, t, g, unknown or other
  modified_base (559)..(927): a, c, t, g, unknown or other
  modified_base (1029)..(1029): a, c, t, g, unknown or other
  modified_base (1123)..(1773): a, c, t, g, unknown or other
  modified_base (1902)..(1902): a, c, t, g, unknown or other
  modified_base (2001)..(2001): a, c, t, g, unknown or other
  modified_base (2107)..(2109): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaatggcaaaaacgtgcaccggttgtgacaataatgggtcatgttgaccacgggaaaaccacattgttggatgctttgcggcattcgaacattgtggccggtgaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaggaagcaattcttctccaggccgagttgttggaattgcattcaaccccaaagggcgcagtggaggcaacaatcattgaatcaagcaaaattcaagcncttggcattgtcacaactttgattgtgaatcgaggaacattgaagcggggaacagtgttggttgccggcacaagttgggcaaaagtgcgaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaacatcatttgggcgagggaacggttttggtggaatatcgattgagtgaaggaatgaaaaaaagacagccaattgccggcattcgagtcgattccggcataatggataagtaaaggaatgggggntcgaatgattcgacaattctaatttatgaaggccaaattgaatcaatgcaacatcaaaaaatgccaattaatgaagcaaaaatggaaatggaaattgcnattgctgttgaggacaaaaatgtgcgttacaaagagggcgaccgagtggaatgctatgaaaatgttgtggtggaacaaaaaattggatgggatccacctggatttnnn

SEQ ID NO: 938 - DNA, 1917 bp, Artificial Sequence
  Description of Artificial Sequence: Synthetic polynucleotide
  modified_base (1)..(183): a, c, t, g, unknown or other
  modified_base (201)..(201): a, c, t, g, unknown or other
  modified_base (204)..(205): a, c, t, g, unknown or other
  modified_base (207)..(208): a, c, t, g, unknown or other
  modified_base (210)..(211): a, c, t, g, unknown or other
  modified_base (219)..(219): a, c, t, g, unknown or other
  modified_base (226)..(226): a, c, t, g, unknown or other
  modified_base (228)..(228): a, c, t, g, unknown or other
  modified_base (230)..(231): a, c, t, g, unknown or other
  modified_base (234)..(237): a, c, t, g, unknown or other
  modified_base (239)..(244): a, c, t, g, unknown or other
  modified_base (246)..(246): a, c, t, g, unknown or other
  modified_base (248)..(252): a, c, t, g, unknown or other
  modified_base (255)..(256): a, c, t, g, unknown or other
  modified_base (261)..(264): a, c, t, g, unknown or other
  modified_base (267)..(267): a, c, t, g, unknown or other
  modified_base (270)..(271): a, c, t, g, unknown or other
  modified_base (273)..(273): a, c, t, g, unknown or other
  modified_base (275)..(276): a, c, t, g, unknown or other
  modified_base (279)..(279): a, c, t, g, unknown or other
  modified_base (282)..(282): a, c, t, g, unknown or other
  modified_base (286)..(289): a, c, t, g, unknown or other
  modified_base (292)..(293): a, c, t, g, unknown or other
  modified_base (297)..(297): a, c, t, g, unknown or other
  modified_base (300)..(300): a, c, t, g, unknown or other
  modified_base (303)..(303): a, c, t, g, unknown or other
  modified_base (306)..(308): a, c, t, g, unknown or other
  modified_base (311)..(313): a, c, t, g, unknown or other
  modified_base (315)..(316): a, c, t, g, unknown or other
  modified_base (318)..(318): a, c, t, g, unknown or other
  modified_base (321)..(327): a, c, t, g, unknown or other
  modified_base (330)..(332): a, c, t, g, unknown or other
  modified_base (334)..(336): a, c, t, g, unknown or other
  modified_base (338)..(339): a, c, t, g, unknown or other
  modified_base (342)..(344): a, c, t, g, unknown or other
  modified_base (346)..(346): a, c, t, g, unknown or other
  modified_base (348)..(349): a, c, t, g, unknown or other
  modified_base (355)..(355): a, c, t, g, unknown or other
  modified_base (358)..(358): a, c, t, g, unknown or other
  modified_base (361)..(363): a, c, t, g, unknown or other
  modified_base (365)..(367): a, c, t, g, unknown or other
  modified_base (369)..(369): a, c, t, g, unknown or other
  modified_base (445)..(465): a, c, t, g, unknown or other
  modified_base (585)..(585): a, c, t, g, unknown or other
  modified_base (739)..(1917): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgggccggcaaaaggncanntnntnngggaaatngatgcantngnnggnnnnannnnnngnannnnngannaaacnnnnatncanntncnnatnctnaatnnnngtnnaggnccngcngtnnntgnnntnngngcnnnnnnngannngnnntnntannngnanncaatgnaanaannnannnanaaagaatctaatctaacgatgcgtcagggcatggtagatcgtctaatcgtagaggatggtcagtgtgtaggagttnnnnnnnnnnnnnnnnnnnnnatttcctgcccaacactggtgctcactactggcacattcctcaatggaacattgcattggggacaaaaacaaatggacggtggacgaattggtgaggcatcgagcagcggattgacaagnacattcaatcgattgggcttcaaaacaggccgtttgagcactggaacaccacccagattattatccagcacaattgactttgctaaattccaagcacgcccatctgatgccgagccaatgccattctcatttttgaatgaatccgttggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 939 - DNA, 3132 bp, Artificial Sequence; identical to SEQ ID NO: 634
  Description of Artificial Sequence: Synthetic polynucleotide
  modified_base (1)..(441): a, c, t, g, unknown or other
  modified_base (670)..(1692): a, c, t, g, unknown or other
  modified_base (1777)..(1779): a, c, t, g, unknown or other
  modified_base (1912)..(2487): a, c, t, g, unknown or other
  modified_base (2722)..(3132): a, c, t, g, unknown or other

SEQ ID NO: 940 - DNA, 645 bp, Artificial Sequence
  Description of Artificial Sequence: Synthetic polynucleotide
  modified_base (1)..(177): a, c, t, g, unknown or other
  modified_base (343)..(645): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttcagctacgtcatcaaaggggcgatttgtgcactttcactttgcgaccaaaatttctccagaaaaactgcatttgcctatttggaagacatcgccaatgaattcaacaatcaatatgcaacacaagttggtgcggcaacgcgtccttatcattttctcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 941 - DNA, 555 bp, Artificial Sequence
  Description of Artificial Sequence: Synthetic polynucleotide
  modified_base (1)..(27): a, c, t, g, unknown or other
  modified_base (180)..(180): a, c, t, g, unknown or other
  modified_base (412)..(555): a, c, t, g, unknown or other
nnnnnnnnnnnnnnnnnnnnnnnnnnngatctttacagcattaaagcaattctaattttggaccaagatggaaagcgaatattgggaaaatattacgacaaagagacatttccacaggagaaggagcaaaccgcattcgagaagagccttttccagaaaacacacaaaaattgttcgccngaaattattttgctcgatggcctcattgcgtttatcgttcaatggtggatttgttcttctacgtgattgggagtgccaaaagaaaatgaattgatcctgcaaagtgttttgaattgcctgttcgatgcaattgccactgttttgcgcaaaaatgtggaaaagaaggccttgtttgatcatattgacatcgccttcttgattttggatgaaatatgcgatgatgggtttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 942 - DNA, 1026 bp, Artificial Sequence
  Description of Artificial Sequence: Synthetic polynucleotide
  modified_base (1)..(48): a, c, t, g, unknown or other
  modified_base (274)..(345): a, c, t, g, unknown or other
  modified_base (484)..(1026): a, c, t, g, unknown or other
nnnnnnnnnnnnnnnnnnnnnnnnnnnnnnnnnnnnnnnnnnnnnnnnttgcagcgatttgtgctgaatgagcagaaaaaatttccggaggccaccggcgatttgacaacccttttgaccagcttgttgaccgcggttaaggccatctcatcggcagttcggaaagccggattggcccaattgtatggagtggccgggaatgtgaatgtgcaaggggaggatgtaaaaaaattggatgttttgagcaatgagttgatgataaacatgctcaaannnnnnnnnnnnnnnnnnnnnnnnnnnnnnnnnnnnnnnnnnnnnnnnnnnnnnnnnnnnnnnnnnnnnnnnggcaaatatattgtcacattcgacccattggacggttcctccaacattgattgcctcgtttcaattggcaccatttttgggatattccgaaagccgggcgatggccccacaacgccacaggacattcttcaacccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 943 - DNA, 1329 bp, Artificial Sequence
  Description of Artificial Sequence: Synthetic polynucleotide
  modified_base (1)..(690): a, c, t, g, unknown or other
  modified_base (805)..(1329): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcaggttccaagcgttcatcacacagcaatgcgtatatgtatggcttttggaagaataaacggattgttctgtacgatacccttttgagcaaggaaatgaatgaacaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 944 - DNA, 1059 bp, Artificial Sequence; identical to SEQ ID NO: 459
  Description of Artificial Sequence: Synthetic polynucleotide
  modified_base (1)..(342): a, c, t, g, unknown or other
  modified_base (378)..(378): a, c, t, g, unknown or other
  modified_base (475)..(774): a, c, t, g, unknown or other
  modified_base (991)..(1059): a, c, t, g, unknown or other

SEQ ID NO: 945 - DNA, 1758 bp, Artificial Sequence
  Description of Artificial Sequence: Synthetic polynucleotide
  modified_base (1)..(6): a, c, t, g, unknown or other
  modified_base (436)..(603): a, c, t, g, unknown or other
  modified_base (706)..(708): a, c, t, g, unknown or other
  modified_base (726)..(726): a, c, t, g, unknown or other
  modified_base (766)..(993): a, c, t, g, unknown or other
  modified_base (1402)..(1443): a, c, t, g, unknown or other
  modified_base (1552)..(1554): a, c, t, g, unknown or other
  modified_base (1626)..(1626): a, c, t, g, unknown or other
  modified_base (1693)..(1758): a, c, t, g, unknown or other
nnnnnnataaaaattctttatggttccgaaacgggaaatgcgcaagattttgcagaacaaatatataaaaaatgtaggacaaatagtgttttatcggaatgtcttgctatcgatgattatccaatacagaatttgttcgaagaaagaactgccatctttattgtatcgaccagtggtcaaggtgaaatgccttcaaatatgaggaaaaattggctatttttattatcaaagaaattggaaaaaagttggctctcaaatacaaaaattgccgttctaggccttggtgacagttcatatcaaaaatataattatgcagccaaaaaagtatatcggagattaattcaacttggcgcccaacccctacttgatctttcacttgcggacgatcaacatcgattaggaattgatgaaatttttgagaaatggcaaaatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgtcaaagtattttccacttgaattggttgaaaatgaaagattaactgctgaaagtcattttcaagagacacggctaatcactttctcttcaattgacnnnaattcaaataatttcagntattcgcctggggatgttttaatggtgctaccggaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaggaaagacttgttgaactttcatctcctgaaggaattgatgattatctcgattattgtgtgcattcaagacgaactatggctgaatttctgcgcgatttcccggaaacttcctcatccctcactccaaatgatatgttcgaatttttccctgcaataaggccccggggatttagtattgcttcttctccccatccggacaaaattcaaattttggttgctcgagttgaatatacggttcgtaaaaataaattaagacttggactgtgcagcaattttctttgtgctttaaaaactgggagacgggtttttctacgaattcgccaaggcgtttttgttcataaaaacagcgaagagccattaattttgattggacccggcactggaattgccccattccgatcannnnnnnnnnnnnnnnnnnnnnnnnnnnnnnnnnnnnnnnnncttcttttctttggttgtagaggcgaattccgagatttttatttccgcgatgaatggttgaaatgttcaaaagcacaaattgtgacggcattttcgcgggaccaggaannnaagaagatttatgttcaacataaaattgttcgaaatggaaaagaaattttcgaattgttgaatcaaggagancgtatttttattgccggtgcatccggtgatatgccaaaacaagttattgccgcattgaagaatgttnnnnnnnnnnnnnnnnnnnnnnnnnnnnnnnnnnnnnnnnnnnnnnnnnnnnnnnnnnnnnnnnnn

SEQ ID NO: 946 - DNA, 1659 bp, Artificial Sequence
  Description of Artificial Sequence: Synthetic polynucleotide
  modified_base (1)..(207): a, c, t, g, unknown or other
  modified_base (469)..(963): a, c, t, g, unknown or other
  modified_base (1011)..(1011): a, c, t, g, unknown or other
  modified_base (1095)..(1095): a, c, t, g, unknown or other
  modified_base (1249)..(1251): a, c, t, g, unknown or other
  modified_base (1362)..(1362): a, c, t, g, unknown or other
  modified_base (1554)..(1554): a, c, t, g, unknown or other
  modified_base (1657)..(1659): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaaaaaattttaactatcatcgacgggcgcggcactttccaaagcaatgaattggcagaagagctggacattgaccatcaaaaattggttggcgcaatcaaaagtttgcaggcgcaggatgggttaattgatgtgaaggagacgaaattgaaaagattggaattgaccggcgaaggggaacaaattatggtgaatggatcgcacgaattcaatgtttataagctgattggcgaacagggaatgcccaaaacggaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaacatccggcacgagattcgcatgacactttcttcctctcaagngccggcaattcaactgaatttccgagcgaatatttggaacgcgtccgaaaagttcattccgatggtggatttggctcaagacgntatcaatatgactggaaattggaggaagcccaaaagaatttgcttcgaacgcacacaaccgccgtttcggcccgtcaactttatttgcttgcacaaaatggtttcaaaccggccaaaatgttcagcattgatcgagttttccgcaatgaaactnnngatgccacacatttggccgaattccatcaagtcgagggggttgtggccgaaaggaatttgtcattggcccatgtgattggactgttcactgaattcttcaggaaatgcganatcaacaatcttcgcttcaagccaacctacaatccatatacggaaccgtcgatggaaatattcgcctatcatgatggactgaagaaatgggtggaaattggcaattcgggaatgttccggccggaaatgctcctcccgatgggtttgcccgaggatgttgcggttgccggttttggactttctttggagggnccaacaatgattcgatatgggctaacgaatattcgggaattattcggccacaaaatcaatctggaaatggtgtacaacaatccaatttgccagctggataaannn

SEQ ID NO: 947 - DNA, 1776 bp, Artificial Sequence
  Description of Artificial Sequence: Synthetic polynucleotide
  modified_base (1)..(174): a, c, t, g, unknown or other
  modified_base (265)..(318): a, c, t, g, unknown or other
  modified_base (469)..(469): a, c, t, g, unknown or other
  modified_base (471)..(473): a, c, t, g, unknown or other
  modified_base (475)..(477): a, c, t, g, unknown or other
  modified_base (482)..(483): a, c, t, g, unknown or other
  modified_base (486)..(487): a, c, t, g, unknown or other
  modified_base (489)..(490): a, c, t, g, unknown or other
  modified_base (493)..(493): a, c, t, g, unknown or other
  modified_base (495)..(498): a, c, t, g, unknown or other
  modified_base (500)..(501): a, c, t, g, unknown or other
  modified_base (505)..(506): a, c, t, g, unknown or other
  modified_base (509)..(509): a, c, t, g, unknown or other
  modified_base (537)..(537): a, c, t, g, unknown or other
  modified_base (564)..(564): a, c, t, g, unknown or other
  modified_base (583)..(587): a, c, t, g, unknown or other
  modified_base (589)..(589): a, c, t, g, unknown or other
  modified_base (592)..(592): a, c, t, g, unknown or other
  modified_base (594)..(598): a, c, t, g, unknown or other
  modified_base (601)..(601): a, c, t, g, unknown or other
  modified_base (604)..(605): a, c, t, g, unknown or other
  modified_base (850)..(1044): a, c, t, g, unknown or other
  modified_base (1150)..(1476): a, c, t, g, unknown or other
  modified_base (1576)..(1776): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaggaaatttacaaaattgaaatccccgccaatcgctatgacttgctttgtgtcgagggattggcccgttctctgttgatattccaannnnnnnnnnnnnnnnnnnnnnnnnnnnnnnnnnnnnnnnnnnnnnnnnnnnnnaaatcaataatttattccacacagaccgcctcagtccgagaatttgttgtgggcgctgtcctcagagacatccatttcgatgccgacatctatggctcattcatcgatttgcaggacaaactccatcagaatattggacgaaaacggacantnnntnnnattgnnacnnannatntnnnnannattnnagncccattccgttatgcagcctgtaaaccngcggacattgttttcaaacctttaaancagagcaaggagatgaatnnnnnanaantnnnnnaanttnnttagaaagacagccatttgcgcgaatatttgccaatcattcgggacaaacccgtgtatccggtcatctacgatgcggatggcaccgtctgctcccttccgcccataatcaacagtgaacattcaaaaatcacgctggacacgaaaaatgttttcatcgaggcgaccggcacagatttgaagaagttggaaattgttttggacaccgttgtgacaatgttcagtcaatattgcaaaacgccatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagataacaattccgcccacacgacatgacattttgcatgaatgcgatttggccgaggatttggccctggcctttggctacaattccatcacacccgcctgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaatgaacgacatttggcagccgtcttctacagcaaaacgggcgcattcgaagtgatccatggccttctggatcggctaatgcaaatgttgaatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 948 - DNA, 1335 bp, Artificial Sequence
  Description of Artificial Sequence: Synthetic polynucleotide
  modified_base (1)..(45): a, c, t, g, unknown or other
  modified_base (175)..(264): a, c, t, g, unknown or other
  modified_base (393)..(393): a, c, t, g, unknown or other
  modified_base (436)..(438): a, c, t, g, unknown or other
  modified_base (484)..(531): a, c, t, g, unknown or other
  modified_base (766)..(768): a, c, t, g, unknown or other
  modified_base (832)..(837): a, c, t, g, unknown or other
  modified_base (996)..(996): a, c, t, g, unknown or other
  modified_base (1141)..(1335): a, c, t, g, unknown or other
nnnnnnnnnnnnnnnnnnnnnnnnnnnnnnnnnnnnnnnnnnnnngaatgtattctctctgggatgctctccgtttctggcaagaaagtgcttcatattgatcgaaacaattattatggcgccgactctgcctccctcaccccacttgacgagctttataagaaattcaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaaacttctcattcataccggcgttactcgctatttggaatttaaatcaatcgaaggatcctatgtgtacaaaggtggcaaaatttacaaagtgccggcggatgaaatggaagctttggccacagtnctaatgggaatgttcgagaaacgccgcttcaagaaatttttgnnntgggttcaatcatttgatccgaatgagccgaaaacttgggaggggnnnnnnnnnnnnnnnnnnnnnnnnnnnnnnnnnnnnnnnnnnnnnnnnttggatgaaaacaccgcggatttcaccggccatgccactggcttataccgcgacgacaattacaaacaacaaccgtacgcccaaaccgtgagccgtattcgtctctacagtgattcgttggctcgctatggcaaatccccgtatctttatccactctatgggctgggcgaattgccgcaggggtttgcccgtctttcgagcatttatgggggaacttacatgttggacaaacccnnngaccaaattgttttcgagggcggcaaggctgtgggcgttaagagtggaaatgaagtggccaaannnnnnaagatctattgtgacccatcctatgtggacagtaaaagtgaagaagttggccaagtggttcgcgcaatttgcctactcaatcatccaattgcaaacacaaatgacgcggccagttgccaaatcatcattccgcaaaagcaggttggacgtcattcaacnatttacatttcgtgcgtttccaattccaatcaagtggcaccaaagagtttttatattgcgaatgtgtccacaacggtggagacatcaaatccggaggccgaaattcaaccggcacttcagctgttgggcccaataatcgagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 949 - DNA, 1068 bp, Artificial Sequence; identical to SEQ ID NO: 603
  Description of Artificial Sequence: Synthetic polynucleotide
  modified_base (1)..(501): a, c, t, g, unknown or other
  modified_base (619)..(1068): a, c, t, g, unknown or other

SEQ ID NO: 950 - DNA, 1656 bp, Artificial Sequence
  Description of Artificial Sequence: Synthetic polynucleotide
  modified_base (1)..(198): a, c, t, g, unknown or other
  modified_base (580)..(762): a, c, t, g, unknown or other
  modified_base (943)..(1173): a, c, t, g, unknown or other
  modified_base (1204)..(1206): a, c, t, g, unknown or other
  modified_base (1536)..(1536): a, c, t, g, unknown or other
  modified_base (1633)..(1656): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttctcaggctcgtcaagccggtgttgaacaatatcgggacaacatgttcgccggagagcccatcaatttcacggagggtcgagcagttttgcacattgcacttcgaaatcggacaaattcgccaatttcagtggacggcaaagatgtaatgccggctgtcaattccgttttggaccatatgcgtcaattttgtgaccaaatcatcaatggggaatggcgcggcttccaaggccataaaattacggatgtggtcaacattggaattggcggttcggatttgggtccatttatggtgacagaagccctcaaaccattccaaaaaggcccaaatgtccattttgtgtccaacattgatggaacgcatttgcaagaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaattgcccgggaaaatatgttcgaattttgggattgggtgggcggccgatattccctttggtccgccattggcctttccattgccgtcaacattggatttgagaatttcgaaaagcttttggagggcgcccacattgcggatgaacattttcgacagaaaccactggaacaaaatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatccatcagggcactcgacttattccgnnngatttcattgccccaatccatagccataatccaatccgcaatggactccatcataacattttattggccaatttccttgcccaaacggaggctctgatgcgcggaaaaacgtcgaatgcagcggaaaatgaattgcgggcagccggcatggacgaaaatcgaatcaaagaaattctgcctcacaaggtattcgaaggcaatcggccaaccaattcaattctggtgccaaaagtgacgccaagcacattgggcacattaattgccatctatgagcataaaatttttgtgcaaggctgcatctggggcattaattcctacgaccaatggggngttgaactgggaaagcaattggccaatgtgattctgaaggaattaaattcggacggcccaattaattcgcatgattctagcacaaatgcgctgatcnnnnnnnnnnnnnnnnnnnnnnnn

SEQ ID NO: 951 - DNA, 1617 bp, Artificial Sequence; identical to SEQ ID NO: 524
  Description of Artificial Sequence: Synthetic polynucleotide
  modified_base (1)..(90): a, c, t, g, unknown or other
  modified_base (265)..(609): a, c, t, g, unknown or other
  modified_base (765)..(765): a, c, t, g, unknown or other
  modified_base (1222)..(1617): a, c, t, g, unknown or other

SEQ ID NO: 952 - DNA, 555 bp, Artificial Sequence
  Description of Artificial Sequence: Synthetic polynucleotide
  modified_base (1)..(432): a, c, t, g, unknown or other
  modified_base (553)..(555): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaattttcagcccaatggattcgaaaaaacatttgccgaaatggatgcagaggagaagaacaaaatatcacatagaggaattgcattggagaaattgaaaaaatttcttgaaacgcatnnn

SEQ ID NO: 953 - DNA, 1278 bp, Artificial Sequence; identical to SEQ ID NO: 571
  Description of Artificial Sequence: Synthetic polynucleotide
  modified_base (1)..(342): a, c, t, g, unknown or other
  modified_base (423)..(423): a, c, t, g, unknown or other
  modified_base (496)..(510): a, c, t, g, unknown or other
  modified_base (765)..(765): a, c, t, g, unknown or other
  modified_base (858)..(858): a, c, t, g, unknown or other
  modified_base (1113)..(1113): a, c, t, g, unknown or other
  modified_base (1258)..(1278): a, c, t, g, unknown or other

SEQ ID NO: 954 - DNA, 393 bp, Artificial Sequence
  Description of Artificial Sequence: Synthetic polynucleotide
  modified_base (1)..(45): a, c, t, g, unknown or other
  modified_base (141)..(141): a, c, t, g, unknown or other
  modified_base (150)..(150): a, c, t, g, unknown or other
  modified_base (193)..(193): a, c, t, g, unknown or other
  modified_base (195)..(195): a, c, t, g, unknown or other
  modified_base (198)..(198): a, c, t, g, unknown or other
  modified_base (207)..(207): a, c, t, g, unknown or other
  modified_base (243)..(243): a, c, t, g, unknown or other
  modified_base (249)..(249): a, c, t, g, unknown or other
  modified_base (267)..(267): a, c, t, g, unknown or other
  modified_base (274)..(274): a, c, t, g, unknown or other
  modified_base (276)..(276): a, c, t, g, unknown or other
  modified_base (280)..(280): a, c, t, g, unknown or other
  modified_base (297)..(297): a, c, t, g, unknown or other
  modified_base (303)..(303): a, c, t, g, unknown or other
  modified_base (321)..(321): a, c, t, g, unknown or other
  modified_base (324)..(324): a, c, t, g, unknown or other
  modified_base (391)..(393): a, c, t, g, unknown or other
nnnnnnnnnnnnnnnnnnnnnnnnnnnnnnnnnnnnnnnnnnnnngcagacagcggagatacaatttttgggaaaataattcgcaaagaaattccggctaaaattatctacgaagatgacacggttctcgccttccatgangtgagtccncaagcgccaatccatttcctggtgatcccgaaaaaggcaattncntcnatggatgcntgcaaaccggaagatgaagctatactcggaaaattnatgttnacggccaagaaaattgcnaacgaananggcntggccaatggctatagnattgtngtgaacaatgggaaaganggntgccagagtgtgttccatctccaccttcatgtgatgggcggacgacaattgggctggccgccgggcnnn

SEQ ID NO: 955 - DNA, 1563 bp, Artificial Sequence
  Description of Artificial Sequence: Synthetic polynucleotide
  modified_base (1)..(513): a, c, t, g, unknown or other
  modified_base (841)..(1563): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagatatcgcgaattctaccaatgtgattttgacattgctggccaaggtgaatcgatggtccaagaggcggaatgtctgaaaattattgacgaagtgcttagcaaattggatttgggacaattcgaaattcgggttaatcaccgtcaacttttggaggcaatgttcgaagccagtggaattccaccaaatttattcaaaactgtatcatcctcggtggacaaattggacaagcaaccttgggccgaaattcgagaggagttgatcaatgagaaaggattggacgagacaatggccaatgccctcggggaatttgttcgaattcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 956 - DNA, 711 bp, Artificial Sequence
  Description of Artificial Sequence: Synthetic polynucleotide
  modified_base (1)..(177): a, c, t, g, unknown or other
  modified_base (294)..(294): a, c, t, g, unknown or other
  modified_base (385)..(390): a, c, t, g, unknown or other
  modified_base (439)..(441): a, c, t, g, unknown or other
  modified_base (484)..(711): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacttcaccgcgcctttagtgtttttatatttgacaaagagcgtcgtttactgctgcaaaagcggtcagcaacaaaaattacattccctgaagtttggacaaatacatgttgcagnaagccatccacattatccaaatgagaaaaatgggaggatggaattaaacaagctgccgagcggaaactaattcatgagttggggattgaannnnnnaatgcgggcaaaatgcatgtgatgggacggttcatttatgaagcgagannntctgatccagtgtgggttgaacacgaactggactatgctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 957 - DNA, 3426 bp, Artificial Sequence
  Description of Artificial Sequence: Synthetic polynucleotide
  modified_base (1)..(273): a, c, t, g, unknown or other
  modified_base (366)..(366): a, c, t, g, unknown or other
  modified_base (465)..(465): a, c, t, g, unknown or other
  modified_base (514)..(516): a, c, t, g, unknown or other
  modified_base (753)..(753): a, c, t, g, unknown or other
  modified_base (1153)..(1308): a, c, t, g, unknown or other
  modified_base (1509)..(1509): a, c, t, g, unknown or other
  modified_base (1683)..(1683): a, c, t, g, unknown or other
  modified_base (2058)..(2058): a, c, t, g, unknown or other
  modified_base (2230)..(2883): a, c, t, g, unknown or other
  modified_base (3091)..(3426): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcctgttgaatttgaagttgacaaacaattgggcatcaaaggaccgagtgacgtgatgaatatgggaattgctgcttacaatgcaaaagtncgcggaattgtgatgcgctatgcagaagaatggcaacatgcagttgagcggactgggcgttggatcgattttgacaatgattataaaaccctttatacntggttcatggagaccgtttggtgggtattcgcccaactttacaaaaggnnnttggtctatcggggcgtaaaagttatgcctttttcgaccggttgttcaactccattatccaactttgaagccggccaaaattacaaagatactgttgacccatcagtttatgtggcatttccattaatagagaagccaaatcgcgcattcattgcttggactacaacaccgtggactctgcctagcaatatggcactttgtgttaatcctgaccttgtctatgtagttattcaaacnaagaaagacaaacgtgaatttattttaatgaaagagcggttagccgaattgaaatcggagagttaccaaattttggaagaatttaaaggcagcgaattgtccggacaagcttatattccaccattcccatattttacgcatttgaaagaagagagaaaaattcatattgttgtaaccaatcattatgtaagaactgatgcgggtaccggggttgttcatcaagcaccttattttggcgaggatgattataagacttgcctagagcatgggattatcagcaaagattctataatggtttgccctgttgacgaaaagggaattttcacggaggaggtcactgatttcgcgggactctatgtcaaagatgcggacaaacaaatcatcaaagctttgaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccttcctttgttcgggacaagcgctttgcaaattggttgcgcgatgcccgcgattgggctattagtcgaaatcgattctggggcacaccaataaatttatggacaagcgatgatttcgcggagataatttgtccaagctcaattgccgaactagaagagttgactggcgtgaaaatcaccgatttacatagagagaanattgacgatttgaaaatcccatcgaaaacgggccgaggagaattgaaacgagtgagtgaagtattcgactgctggtttgaatcgggctcgatgccttatgcccaacaacattacccattcgagaatgccgaagtttttgagaacaatttcccggcagattttatcgcagaaganattgaccagactcgtggttggttctacacattgttggttatttcaacagcgctcttcaatcgaccaccattcaaaaatttgatttgtaatggtctagttctggcttcggatggcaataaaatgtccaaaagtaaaaagaactatccggatccaatggaaattgttgaaaaatatggggccgattctcttcgtctctatttgatcaattcacctgttgtgagaggagaaaacttacgtttccaagaagaaggcgtcgctgaagtgataaagcaagtgatgaatccatggttcaatgcctacaaatttttgagcatggcaatgaacaaattcgaagctgtaagatcttcaattaaatatattaacagacaaatatcnttcaacaatgttatggaccaatggatcctttcattcaccaacagcctcattgattttgtgcataaggagatgaaggaatatcacttgtacgcggttgtttcacctcttgtcaattattttgaggcgcttaccaacacttatattcgtttgaatcgaagccgaatcaaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgtcatgatcaacaccagtgaagatgagatactacaatcaaagggactagcacgggaagtgaccaatcgcatacaaaaattacgaaaacaaggaaaattgctggagacggataaggcagctgtttattgcatggtgactcctaccgattcacagctcgcaatggccttaaaagccatcataagaacattgagcaatctactgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 958 - DNA, 1338 bp, Artificial Sequence
  Description of Artificial Sequence: Synthetic polynucleotide
  modified_base (1)..(63): a, c, t, g, unknown or other
  modified_base (414)..(414): a, c, t, g, unknown or other
  modified_base (417)..(417): a, c, t, g, unknown or other
  modified_base (439)..(439): a, c, t, g, unknown or other
  modified_base (441)..(441): a, c, t, g, unknown or other
  modified_base (444)..(444): a, c, t, g, unknown or other
  modified_base (450)..(450): a, c, t, g, unknown or other
  modified_base (459)..(459): a, c, t, g, unknown or other
  modified_base (490)..(490): a, c, t, g, unknown or other
  modified_base (492)..(492): a, c, t, g, unknown or other
  modified_base (559)..(561): a, c, t, g, unknown or other
  modified_base (739)..(894): a, c, t, g, unknown or other
  modified_base (1000)..(1338): a, c, t, g, unknown or other
nnnnnnnnnnnnnnnnnnnnnnnnnnnnnnnnnnnnnnnnnnnnnnnnnnnnnnnnnnnnnnnggcgattacacattgaaatcttcaaatgaggaagcaaaagcttacacacaagattggccattacttttgaagaattttgacaaactcaacattcgcacttcacattacactccattggttgagggatgctcgccgttaaaacgcgatataaagaattacatctcagctggatatttcaatttggacaaaccaagcaacccatcaagtcacgaagtggtcgcctgggttaaaagaattctacgcgttcaaaaaactggccatagtggaacactcgatccaaaggtttccggtgtccttgttgtttgcatcgatcgaaccacgcggttggccaaatctcaacagaatgctggnaangaatatgtggccatattcaaantncanaatccngttgaatcngaaaaaaccatccgtcaagcattggacaagntnactggcgcattgttccaacgacctccactcatttctgccgtaaaacgtcaactccggatccgcacgnnntacgaatgcaaattgatcgaattcaatccggccagacagctgggaatttattggatgagctgtgaggcgggcacctatgttcgaacgcacattgtccatttgggtttgatgcttggcgttggtgcacaaatgcaggagttgagacgtgtccgttccggtgtgacctccgaaaatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggagccaaaattttgttgccgggaattttgcgatatgaaaatggaatcgaattgaatgatgaaattgtgattgtcagcaccaaaggggaagccgtatgcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 959 - DNA, 1494 bp, Artificial Sequence
  Description of Artificial Sequence: Synthetic polynucleotide
  modified_base (1)..(624): a, c, t, g, unknown or other
  modified_base (766)..(855): a, c, t, g, unknown or other
  modified_base (938)..(938): a, c, t, g, unknown or other
  modified_base (940)..(940): a, c, t, g, unknown or other
  modified_base (942)..(942): a, c, t, g, unknown or other
  modified_base (991)..(993): a, c, t, g, unknown or other
  modified_base (1042)..(1042): a, c, t, g, unknown or other
  modified_base (1044)..(1046): a, c, t, g, unknown or other
  modified_base (1048)..(1049): a, c, t, g, unknown or other
  modified_base (1053)..(1058): a, c, t, g, unknown or other
  modified_base (1062)..(1063): a, c, t, g, unknown or other
  modified_base (1065)..(1065): a, c, t, g, unknown or other
  modified_base (1074)..(1078): a, c, t, g, unknown or other
  modified_base (1080)..(1083): a, c, t, g, unknown or other
  modified_base (1086)..(1086): a, c, t, g, unknown or other
  modified_base (1088)..(1089): a, c, t, g, unknown or other
  modified_base (1092)..(1092): a, c, t, g, unknown or other
  modified_base (1095)..(1101): a, c, t, g, unknown or other
  modified_base (1105)..(1108): a, c, t, g, unknown or other
  modified_base (1110)..(1110): a, c, t, g, unknown or other
  modified_base (1113)..(1116): a, c, t, g, unknown or other
  modified_base (1118)..(1119): a, c, t, g, unknown or other
  modified_base (1213)..(1219): a, c, t, g, unknown or other
  modified_base (1221)..(1226): a, c, t, g, unknown or other
  modified_base (1229)..(1230): a, c, t, g, unknown or other
  modified_base (1233)..(1235): a, c, t, g, unknown or other
  modified_base (1242)..(1242): a, c, t, g, unknown or other
  modified_base (1244)..(1248): a, c, t, g, unknown or other
  modified_base (1252)..(1254): a, c, t, g, unknown or other
  modified_base (1257)..(1258): a, c, t, g, unknown or other
  modified_base (1263)..(1266): a, c, t, g, unknown or other
  modified_base (1268)..(1272): a, c, t, g, unknown or other
  modified_base (1277)..(1277): a, c, t, g, unknown or other
  modified_base (1280)..(1282): a, c, t, g, unknown or other
  modified_base (1284)..(1284): a, c, t, g, unknown or other
  modified_base (1286)..(1286): a, c, t, g, unknown or other
  modified_base (1288)..(1289): a, c, t, g, unknown or other
  modified_base (1294)..(1295): a, c, t, g, unknown or other
  modified_base (1297)..(1299): a, c, t, g, unknown or other
  modified_base (1302)..(1303): a, c, t, g, unknown or other
  modified_base (1305)..(1305): a, c, t, g, unknown or other
  modified_base (1307)..(1307): a, c, t, g, unknown or other
  modified_base (1309)..(1310): a, c, t, g, unknown or other
  modified_base (1314)..(1314): a, c, t, g, unknown or other
  modified_base (1317)..(1317): a, c, t, g, unknown or other
  modified_base (1387)..(1494): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggccacggcaacttctatgattccttcctgaacagcggattgttggacaaattcattaaacaaggggaagaaatatgtttcctttcgaacattgacaatttgggtgccacggtcgacccaaacattctgaattatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatatgaggaacggcttatgctgctggaaattgcgcaagttccgccggactatgtggatgaattcaaatcagtcagcaaatncngnattttcaacaccaataatctttgggccgatttggaagcaatcaagcgannngttgtggaacgggaattgaacatggaagtgattgtgaacccaaaacatntnnncnntggnnnnnntgtnntncaattggannnnncnnnnggngnngcnatnnnnnnnttcnnnngngcnnnngnnatttgtgttcctcgctcgcgttttttaccagttaaatccactcgtgatctattccgaatgcgatcaccgtgcctttttcaattcgacccggacnnnnnnntnnnnnnccnncgnnnattcccnannnnnccgnnngtnnaattnnnnannnnntttgncannntnanannatttnngnnncgnntncnannaatnccngaccttttggaattggatcatttaacggtgtccggcgatgtttggtttggccgagatgtgacattgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 960 - DNA, 1719 bp, Artificial Sequence; identical to SEQ ID NO: 602
  Description of Artificial Sequence: Synthetic polynucleotide
  modified_base (1)..(63): a, c, t, g, unknown or other
  modified_base (223)..(225): a, c, t, g, unknown or other
  modified_base (277)..(324): a, c, t, g, unknown or other
  modified_base (420)..(420): a, c, t, g, unknown or other
  modified_base (559)..(573): a, c, t, g, unknown or other
  modified_base (886)..(1353): a, c, t, g, unknown or other
  modified_base (1642)..(1719): a, c, t, g, unknown or other

SEQ ID NO: 961 - DNA, 1596 bp, Artificial Sequence; identical to SEQ ID NO: 479
  Description of Artificial Sequence: Synthetic polynucleotide
  modified_base (1)..(369): a, c, t, g, unknown or other
  modified_base (538)..(1596): a, c, t, g, unknown or other

SEQ ID NO: 962 - DNA, 387 bp, Artificial Sequence; identical to SEQ ID NO: 447
  Description of Artificial Sequence: Synthetic polynucleotide
  modified_base (1)..(27): a, c, t, g, unknown or other
  modified_base (166)..(387): a, c, t, g, unknown or other

SEQ ID NO: 963 - DNA, 1335 bp, Artificial Sequence
  Description of Artificial Sequence: Synthetic polynucleotide
  modified_base (1)..(399): a, c, t, g, unknown or other
  modified_base (483)..(483): a, c, t, g, unknown or other
  modified_base (604)..(1335): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgtgcagcagagtctcaccgccaaacaaggaaatatgtcaagtcatgggttaaaccaggaatgaaactgattgacattcgngaacgattggaagcccacagccgccgaatgatcaatgagtcggggctgagcgctggtttggcattcccaacgggttgttcagtcaaccattgcgcagcacattatacaccaaatgccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 964 - DNA, 2646 bp, Artificial Sequence
  Description of Artificial Sequence: Synthetic polynucleotide
  modified_base (1)..(408): a, c, t, g, unknown or other
  modified_base (414)..(414): a, c, t, g, unknown or other
  modified_base (515)..(518): a, c, t, g, unknown or other
  modified_base (685)..(810): a, c, t, g, unknown or other
  modified_base (1027)..(1029): a, c, t, g, unknown or other
  modified_base (1441)..(1464): a, c, t, g, unknown or other
  modified_base (1569)..(1569): a, c, t, g, unknown or other
  modified_base (1581)..(1581): a, c, t, g, unknown or other
  modified_base (1584)..(1584): a, c, t, g, unknown or other
  modified_base (1587)..(1587): a, c, t, g, unknown or other
  modified_base (1590)..(1590): a, c, t, g, unknown or other
  modified_base (1623)..(1623): a, c, t, g, unknown or other
  modified_base (1635)..(1635): a, c, t, g, unknown or other
  modified_base (1641)..(1641): a, c, t, g, unknown or other
  modified_base (1647)..(1647): a, c, t, g, unknown or other
  modified_base (1668)..(1668): a, c, t, g, unknown or other
  modified_base (1707)..(1707): a, c, t, g, unknown or other
  modified_base (1740)..(1740): a, c, t, g, unknown or other
  modified_base (1746)..(1746): a, c, t, g, unknown or other
  modified_base (1761)..(1761): a, c, t, g, unknown or other
  modified_base (1782)..(1782): a, c, t, g, unknown or other
  modified_base (1828)..(2646): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgangatgaggacattccaattgatattctggaaaatacacgtggccgatcatcgaaggatcattgcagtgatgaggccattgggattgcaattgcaaaaaggtnnnnaaaatttttgcgcgttttcaaggatccatcgagcggacagaacaaatatattctggcaattaagcatatggtcgcccataatcgcgtttcccttgaagtggattacaacgatttggcacatgagagcggcgatccaagtattgcatatttcttgccagaggctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgactgcttcgacaaatccacctaaatatgttgataaaaaccaccggagtggtcacaatgaccacgggcattctccctcaattggccatcctcaaatatgattgcaaaagttgttcgtttgtgcttggaccatttgttcaacgtcaggatgaggaaacgaagccaaacatttgtccatcttgccagagccggggcccatttgaattgaatgccgaannnaccatctatcacaattaccaacgaataacaatacaagagagtccaaatttggtggctgccggtcgtttgccacgttccaaggaagtcgtcctgctgggtgatttatgcgattcatgcaaacctggagatgaaattgaattgactggcatttacacgcatagctacgatggatcgctgaattcacgccaaggatttcccattttcaacacggttattgtggccaaccatgtggtcaaaaaggatcgccttgagtctgattcgctcacggatgaggacataaaagccattcaagaactctcaaaacatcctcaaattgcccgccgaatttttgccagcatttctccaactatttatgggcatgatgaagttaaacaggccattggattggcctgttccgaggggaaccaaaaannnnnnnnnnnnnnnnnnnnnnnnaaaggtgatatcaatgttttgctttgtggtgatcccggcaccgcaaagtcacaattccttcgatatgttgttcatttagcaccgcgggccgtgcttaccacaggncaaggcgcatcngcngtnggnttaaccgcctatgttcaacgccatccagtaacncgggaatggacnctggangctggngcaatggttttggcggacacnggcgtttgcctcatcgacgaattcgacaaaatgaatgancaggaccgaaccagcattcatgaggcaatggancaacantccatttcaatctcnaaagccggcattgtcacatcnttgagggcccgctgtacggtcattgcggccgcaaatccaattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 965 - DNA, 2280 bp, Artificial Sequence
  Description of Artificial Sequence: Synthetic polynucleotide
  modified_base (1)..(606): a, c, t, g, unknown or other
  modified_base (756)..(756): a, c, t, g, unknown or other
  modified_base (874)..(975): a, c, t, g, unknown or other
  modified_base (1090)..(1383): a, c, t, g, unknown or other
  modified_base (1537)..(1737): a, c, t, g, unknown or other
  modified_base (1837)..(2052): a, c, t, g, unknown or other
  modified_base (2167)..(2169): a, c, t, g, unknown or other
  modified_base (2218)..(2280): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccaactccaacgctgtccaatggatccgtatgcattgttgccggataaatgccaatgcgtggattttcaacaattaaaattgcaagaattgccggaggatgtgccccacagtgaaatgccacggcacatgattatttatgcggatagntatttgacggacaaagtgaccccgggcaatcgagtgaccatcaccggtgtttattccatcaaacggctgttgggcggcaaaaagggtggcggggaaaagaggagaaaacggccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatccgaatatctacaaaataatcagccgaagcattgctccatcaatttacggcgccgaggacataaaacgggcgatcgcatgccttctcttcagtggctcccgaaaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacagcaaacaatcagcattgcaaaggccggcatcacaacaacgctgaattcgcgttgttcagttttggccgccgccaattccgtttttggccgttgggatgacagccgtggcgacgagaacattgattttatgcccacaatcctctcccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgttttattgcctatgcccgtgcgaattgtgggccacgaatatcggaaaaggccacccaattgttgctgaatcaatacgtcaaaatgcgaaatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtttcacctcccgtgaggagcaggaatcattcaatcgagtggaacgccaattgaagaaacgtttccaagtgggcacatacgtttccgagcatttgatcatcgacgaattcnnngccaaacaaagttatgccgaaggattggttcgaaaggtaaccgtaaatnnnnnnnnnnnnnnnnnnnnnnnnnnnnnnnnnnnnnnnnnnnnnnnnnnnnnnnnnnnnnnn

SEQ ID NO: 966 - DNA, 612 bp, Artificial Sequence
  Description of Artificial Sequence: Synthetic polynucleotide
  modified_base (1)..(393): a, c, t, g, unknown or other
  modified_base (607)..(612): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagacaaataactgcttcagttgcattcctcccatttctcgagtctcaatgttcattcgatgtgctcatctacacatttaaagacaccgaaatgccggagggatgggccgactcgaccgaatgtcaaataaaggatgccgaacaagttcaattgcgctctttttcaacagcggttcacaatgttctgacaaaagtgcaatacaagaccgatnnnnnn

SEQ ID NO: 967 - DNA, 3081 bp, Artificial Sequence; identical to SEQ ID NO: 593
  Description of Artificial Sequence: Synthetic polynucleotide
  modified_base (1)..(291): a, c, t, g, unknown or other
  modified_base (346)..(348): a, c, t, g, unknown or other
  modified_base (474)..(474): a, c, t, g, unknown or other
  modified_base (496)..(496): a, c, t, g, unknown or other
  modified_base (500)..(501): a, c, t, g, unknown or other
  modified_base (505)..(505): a, c, t, g, unknown or other
  modified_base (507)..(507): a, c, t, g, unknown or other
  modified_base (510)..(510): a, c, t, g, unknown or other
  modified_base (512)..(512): a, c, t, g, unknown or other
  modified_base (516)..(516): a, c, t, g, unknown or other
  modified_base (523)..(523): a, c, t, g, unknown or other
  modified_base (534)..(534): a, c, t, g, unknown or other
  modified_base (543)..(543): a, c, t, g, unknown or other
  modified_base (546)..(546): a, c, t, g, unknown or other
  modified_base (556)..(558): a, c, t, g, unknown or other
  modified_base (562)..(562): a, c, t, g, unknown or other
  modified_base (564)..(565): a, c, t, g, unknown or other
  modified_base (567)..(567): a, c, t, g, unknown or other
  modified_base (576)..(579): a, c, t, g, unknown or other
  modified_base (582)..(583): a, c, t, g, unknown or other
  modified_base (588)..(589): a, c, t, g, unknown or other
  modified_base (606)..(610): a, c, t, g, unknown or other
  modified_base (612)..(612): a, c, t, g, unknown or other
  modified_base (618)..(618): a, c, t, g, unknown or other
  modified_base (625)..(627): a, c, t, g, unknown or other
  modified_base (631)..(631): a, c, t, g, unknown or other
  modified_base (633)..(633): a, c, t, g, unknown or other
  modified_base (651)..(652): a, c, t, g, unknown or other
  modified_base (654)..(654): a, c, t, g, unknown or other
  modified_base (658)..(660): a, c, t, g, unknown or other
  modified_base (662)..(663): a, c, t, g, unknown or other
  modified_base (666)..(666): a, c, t, g, unknown or other
  modified_base (669)..(670): a, c, t, g, unknown or other
  modified_base (672)..(672): a, c, t, g, unknown or other
  modified_base (674)..(674): a, c, t, g, unknown or other
  modified_base (676)..(676): a, c, t, g, unknown or other
  modified_base (678)..(678): a, c, t, g, unknown or other
  modified_base (685)..(685): a, c, t, g, unknown or other
  modified_base (688)..(691): a, c, t, g, unknown or other
  modified_base (693)..(694): a, c, t, g, unknown or other
  modified_base (696)..(696): a, c, t, g, unknown or other
  modified_base (698)..(699): a, c, t, g, unknown or other
  modified_base (705)..(705): a, c, t, g, unknown or other
  modified_base (714)..(714): a, c, t, g, unknown or other
  modified_base (720)..(720): a, c, t, g, unknown or other
  modified_base (731)..(731): a, c, t, g, unknown or other
  modified_base (739)..(739): a, c, t, g, unknown or other
  modified_base (741)..(741): a, c, t, g, unknown or other
  modified_base (744)..(744): a, c, t, g, unknown or other
  modified_base (747)..(747): a, c, t, g, unknown or other
  modified_base (750)..(750): a, c, t, g, unknown or other
  modified_base (753)..(753): a, c, t, g, unknown or other
  modified_base (763)..(763): a, c, t, g, unknown or other
  modified_base (768)..(768): a, c, t, g, unknown or other
  modified_base (771)..(772): a, c, t, g, unknown or other
  modified_base (774)..(774): a, c, t, g, unknown or other
  modified_base (781)..(781): a, c, t, g, unknown or other
  modified_base (783)..(786): a, c, t, g, unknown or other
  modified_base (789)..(790): a, c, t, g, unknown or other
  modified_base (792)..(795): a, c, t, g, unknown or other
  modified_base (798)..(798): a, c, t, g, unknown or other
  modified_base (801)..(802): a, c, t, g, unknown or other
  modified_base (804)..(804): a, c, t, g, unknown or other
  modified_base (813)..(813): a, c, t, g, unknown or other
  modified_base (816)..(816): a, c, t, g, unknown or other
  modified_base (819)..(819): a, c, t, g, unknown or other
  modified_base (827)..(827): a, c, t, g, unknown or other
  modified_base (829)..(829): a, c, t, g, unknown or other
  modified_base (834)..(834): a, c, t, g, unknown or other
  modified_base (837)..(837): a, c, t, g, unknown or other
  modified_base (964)..(1227): a, c, t, g, unknown or other
  modified_base (1462)..(2568): a, c, t, g, unknown or other
  modified_base (2725)..(2763): a, c, t, g, unknown or other
  modified_base (2925)..(2925): a, c, t, g, unknown or other
  modified_base (3076)..(3081): a, c, t, g, unknown or other

SEQ ID NO: 968 - DNA, 1464 bp, Artificial Sequence; identical to SEQ ID NO: 477
  Description of Artificial Sequence: Synthetic polynucleotide
  modified_base (1)..(1065): a, c, t, g, unknown or other
  modified_base (1225)..(1464): a, c, t, g, unknown or other

SEQ ID NO: 969 - DNA, 2475 bp, Artificial Sequence
  Description of Artificial Sequence: Synthetic polynucleotide
  modified_base (1)..(201): a, c, t, g, unknown or other
  modified_base (313)..(315): a, c, t, g, unknown or other
  modified_base (433)..(741): a, c, t, g, unknown or other
  modified_base (832)..(834): a, c, t, g, unknown or other
  modified_base (840)..(840): a, c, t, g, unknown or other
  modified_base (844)..(844): a, c, t, g, unknown or other
  modified_base (847)..(847): a, c, t, g, unknown or other
  modified_base (849)..(850): a, c, t, g, unknown or other
  modified_base (852)..(853): a, c, t, g, unknown or other
  modified_base (861)..(862): a, c, t, g, unknown or other
  modified_base (867)..(868): a, c, t, g, unknown or other
  modified_base (903)..(903): a, c, t, g, unknown or other
  modified_base (906)..(907): a, c, t, g, unknown or other
  modified_base (913)..(914): a, c, t, g, unknown or other
  modified_base (917)..(917): a, c, t, g, unknown or other
  modified_base (928)..(930): a, c, t, g, unknown or other
  modified_base (933)..(934): a, c, t, g, unknown or other
  modified_base (936)..(938): a, c, t, g, unknown or other
  modified_base (942)..(942): a, c, t, g, unknown or other
  modified_base (944)..(944): a, c, t, g, unknown or other
  modified_base (946)..(947): a, c, t, g, unknown or other
  modified_base (952)..(952): a, c, t, g, unknown or other
  modified_base (966)..(966): a, c, t, g, unknown or other
  modified_base (1020)..(1020): a, c, t, g, unknown or other
  modified_base (1044)..(1044): a, c, t, g, unknown or other
  modified_base (1052)..(1052): a, c, t, g, unknown or other
  modified_base (1056)..(1059): a, c, t, g, unknown or other
  modified_base (1065)..(1065): a, c, t, g, unknown or other
  modified_base (1069)..(1069): a, c, t, g, unknown or other
  modified_base (1071)..(1071): a, c, t, g, unknown or other
  modified_base (1074)..(1074): a, c, t, g, unknown or other
  modified_base (1077)..(1077): a, c, t, g, unknown or other
  modified_base (1080)..(1080): a, c, t, g, unknown or other
  modified_base (1084)..(1084): a, c, t, g, unknown or other
  modified_base (1086)..(1086): a, c, t, g, unknown or other
  modified_base (1092)..(1092): a, c, t, g, unknown or other
  modified_base (1257)..(1259): a, c, t, g, unknown or other
  modified_base (1261)..(1264): a, c, t, g, unknown or other
  modified_base (1266)..(1270): a, c, t, g, unknown or other
  modified_base (1272)..(1273): a, c, t, g, unknown or other
  modified_base (1275)..(1278): a, c, t, g, unknown or other
  modified_base (1290)..(1291): a, c, t, g, unknown or other
  modified_base (1329)..(1329): a, c, t, g, unknown or other
  modified_base (1357)..(1357): a, c, t, g, unknown or other
  modified_base (1404)..(1404): a, c, t, g, unknown or other
  modified_base (1411)..(1411): a, c, t, g, unknown or other
  modified_base (1413)..(1416): a, c, t, g, unknown or other
  modified_base (1476)..(1476): a, c, t, g, unknown or other
  modified_base (1861)..(1872): a, c, t, g, unknown or other
  modified_base (1996)..(1996): a, c, t, g, unknown or other
  modified_base (1998)..(1998): a, c, t, g, unknown or other
  modified_base (2001)..(2001): a, c, t, g, unknown or other
  modified_base (2092)..(2475): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcgaatttgcaaacttccaacgaccgaatcttcactgaccaacaaggtgtacgtaaatcagcaggatttggatgccactttgaccaattttgttcgcgtccaaacatcannngtgcatcattatgttttctcattggccaaccacattggagtcaagccaggcgagatcggtttttcacttccacaacggcgctggaccaacgtctcattggagcaggaaatacaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgtgaccttggcccgttgagcccaaatgccgttgtcatttttgatcgaccagagaattcccaaatcaatttgattggccgaagcaagnnnaaatcntcanacngnncnntgatcaannccganngggacttccaacaaatgggcattggtgggctgganaannagttcnntgncatcttccgcnnngcnntnnnttcncntnncttcncgcccgaattcatngaacaattggcaatgaagcatgttcgtggcattctcctctttggcccacctggnaccgggaagacattaattgcacgncaggttgnaaannnnttgaangccngnganccnaanattntnaatggncccgaaatactgaacaaatacgttggcgaatccgaggccaacatgcgcaaattgtttgccgaggcggaggaggaatttcgtcgctgtggctccaattccggtttacacatcatcatttttgacgagattgatgcgatttgcaagcagcgaggtcaagccggttcnnncnnnngnnnnnannannnnattgtgaacacnntgctagcaaaattggatggtgtggaacaattgaacaanattttgatcattggaatgacaaattttntggacaccatcgatccggccttacttcgacctggccgtctggaattncaagtgnannnntcgctgcccgatgagcatggccgagtgcaaattttgaaaattcatactgcccgaatgagngaatacaaaaaattggacccgagcgttgatctggcggagattgggcgcaagacgaagaatttttctggtgccgagctcgaaggccttgtccgtgctgcccaatcatcggcgatgaaccggctggtgaaagcgggaggcaaagtccaggtggatgaggacgccgtggagaagctgatgatcacccgcgatgatttcgactatgcgctggaaaatgacgtcaagccggcctttggccataatgacgaggagttgggccgattgctctacggtggactcgtttgctggggcgatccggtgacacgcgtgctcgaccaaggcgatttattgatcaaagaaacggcggcaatcgacacccgaggatttgtgcgagcacttttggccggtnnnnnnnnnnnngggaaaacatatttggccgcgcacattgcccgaaaatcggagtttcccttcatcaaagtgtgcacgccggaggacatggtcggctacagtgagacagcaaaatgtgcccaattgagaaaggttntngangacgcctacaaatccccgctgagctgcatcatcatcgacaacatcgaacgactccttgactactctccgattgggccgcgctattccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 970 - DNA, 741 bp, Artificial Sequence
  Description of Artificial Sequence: Synthetic polynucleotide
  modified_base (172)..(741): a, c, t, g, unknown or other
atgtcgagaggatctagtgcaggatttgaccgtcacataaccatattttcgcctgaaggacgactttatcaagtggaatatgctttcaaggccgcaaattcaacaaatctgactgcagttgggattgcaaccaaaaacacagctgtcatcgcagttcaaaagcgtataccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 971 - DNA, 696 bp, Artificial Sequence
  Description of Artificial Sequence: Synthetic polynucleotide
  modified_base (39)..(39): a, c, t, g, unknown or other
  modified_base (117)..(117): a, c, t, g, unknown or other
  modified_base (240)..(240): a, c, t, g, unknown or other
  modified_base (363)..(363): a, c, t, g, unknown or other
  modified_base (421)..(423): a, c, t, g, unknown or other
  modified_base (595)..(696): a, c, t, g, unknown or other
atgagcgaccgatatagcttctcactcacgacgttcagnccttccggaaagcttatgcaaattgaatatgcgatgaatgccgtcaaaaatgggcctccttctgttggattgaaaganacggactgtgttgttcttgcaacggagaataagcaatcggtcctgtacaatccggagaacaaaattgagaagatcacggaccatattggctgcgtttacagcggaatgggtgctgataacagngttcttgtgcgaaaggcccgcaaaattgcaacggaatatgaacttctttatggcgaagagattccggtgattcagctcgtctccaaagttgccgccattatgcaggagtacacgcaatctggntggtgtccgtccatttggtgttccacattgatcggcggatgggatgcagagaagggannncctttgctgttccaggctgatccatcgggttcctactttccttggaatgcaacggctattgggaagaatgacacaaatgcgaagacatttttggagaaacgctacaatgagaccaatgaacaggccgacgccatccacaccgctttgcttactcttcgtgaatcatacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 972 - DNA, 747 bp, Artificial Sequence; identical to SEQ ID NO: 421
  Description of Artificial Sequence: Synthetic polynucleotide
  modified_base (12)..(12): a, c, t, g, unknown or other
  modified_base (39)..(39): a, c, t, g, unknown or other
  modified_base (87)..(87): a, c, t, g, unknown or other
  modified_base (225)..(225): a, c, t, g, unknown or other
  modified_base (349)..(444): a, c, t, g, unknown or other
  modified_base (550)..(747): a, c, t, g, unknown or other

SEQ ID NO: 973 - DNA, 720 bp, Artificial Sequence
  Description of Artificial Sequence: Synthetic polynucleotide
  modified_base (1)..(120): a, c, t, g, unknown or other
  modified_base (175)..(177): a, c, t, g, unknown or other
  modified_base (270)..(270): a, c, t, g, unknown or other
  modified_base (634)..(720): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcgcacttcttctggcgcattcattccaagccgcgtcacgaacaaattggcannnatcaatgatcacatggtcattatgcgcgcaggagttcaatcggattctcaagcaatggccgacatcatcatttatttggcagaactcaaatcnattcaagacggcgaaccaatgacggtctacaatgttgcccaatatgcccgtaaatttcactacaattatcgcgaacaactcagctgtgttgccattgtggccggttatgatgatgtcaaacagggacaaatctactcagttgccatgggcggttatacaactcgtcagccggtttatatcagtggcagtgggagcacaatgatccacggttacatggatgtgaattggcgagaggggatggccatgaaggaggcgaaagagttggtcaagaccgccgttttcttggcacaataccatgatggtgcttccggaggtgtcatccatttggcaacgattgacaaagacggcatgcaaacagaggtcnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 974 - DNA, 615 bp, Artificial Sequence; identical to SEQ ID NO: 633
  Description of Artificial Sequence: Synthetic polynucleotide
  modified_base (1)..(120): a, c, t, g, unknown or other
  modified_base (262)..(615): a, c, t, g, unknown or other

SEQ ID NO: 975 - DNA, 609 bp, Artificial Sequence
  Description of Artificial Sequence: Synthetic polynucleotide
  modified_base (1)..(243): a, c, t, g, unknown or other
  modified_base (406)..(609): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgctgctcatcattggttgcgaaatcaatggcagagaatttgcgttccgaggatttttggcgtgtcaattgcatgattggcggctatgattctaccgaaaagaagggctacttgagcatgattgaccattacgcaacgaatgttccaagccaggtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 976 - DNA, 855 bp, Artificial Sequence
  Description of Artificial Sequence: Synthetic polynucleotide
  modified_base (1)..(120): a, c, t, g, unknown or other
  modified_base (294)..(294): a, c, t, g, unknown or other
  modified_base (405)..(405): a, c, t, g, unknown or other
  modified_base (739)..(855): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagccaaagtcattcgtgaacaaacatttcgggccaactaaaatgccattggccgagttcaagaagggcacaacaacacttgctttcatctacaagccgaagaatccagcagataagggtggaattgtggtagcggttgattcacgcgcaagtagcggcggttatatactnacgaaggatgtgatgaaaatcttgcgtatcaatgagcgaatggtggccacaatggcgggcggtgcagccgattgtcaattttgggtccaacaagtgtcaaaatattgctanctgttcgaattgcgtgagggaactccaatcactgtatcggctgccagcaaatatttcgccaacgtcatgtatggataccgtaatgccggactcagtgtgggctcaatgattgccggtgttgatgattcggggccagcgctctatcttgtcgaaaatacgggaatgcgaatcaaactgaaatatgtttcggtcggctccggatcgctgaatgcctatggaattttggacacgcaatacaaggcggaaatgaccgatgcggaggcgctgaaactcggacgacaggccattatgcatgctacttatcgtgatggcggttctggcggacaatgcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 977 - DNA, 777 bp, Artificial Sequence
  Description of Artificial Sequence: Synthetic polynucleotide
  modified_base (1)..(339): a, c, t, g, unknown or other
  modified_base (480)..(480): a, c, t, g, unknown or other
  modified_base (610)..(777): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctgaaccattacaaattcacatatcaacatgagatgggcgttgacttgttctccacaatgttggctcgcactttgtactatcgccgcttctttccatattatactggttcaattttggctggaatcactgatgatgangaaggtgccgtctattcgtatgatccaattggcatggtccagcgaacttcttgcgattgttctggtaccggcgcttccatcctccaatccttctttgacatcaaaatcgatgagtgcaccattgacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 978 - DNA, 1254 bp, Artificial Sequence
  Description of Artificial Sequence: Synthetic polynucleotide
  modified_base (1)..(9): a, c, t, g, unknown or other
  modified_base (169)..(172): a, c, t, g, unknown or other
  modified_base (174)..(175): a, c, t, g, unknown or other
  modified_base (177)..(177): a, c, t, g, unknown or other
  modified_base (181)..(182): a, c, t, g, unknown or other
  modified_base (189)..(190): a, c, t, g, unknown or other
  modified_base (196)..(196): a, c, t, g, unknown or other
  modified_base (198)..(198): a, c, t, g, unknown or other
  modified_base (201)..(202): a, c, t, g, unknown or other
  modified_base (204)..(204): a, c, t, g, unknown or other
  modified_base (207)..(207): a, c, t, g, unknown or other
  modified_base (211)..(212): a, c, t, g, unknown or other
  modified_base (214)..(216): a, c, t, g, unknown or other
  modified_base (219)..(227): a, c, t, g, unknown or other
  modified_base (229)..(229): a, c, t, g, unknown or other
  modified_base (233)..(233): a, c, t, g, unknown or other
  modified_base (237)..(237): a, c, t, g, unknown or other
  modified_base (239)..(242): a, c, t, g, unknown or other
  modified_base (246)..(250): a, c, t, g, unknown or other
  modified_base (253)..(256): a, c, t, g, unknown or other
  modified_base (265)..(266): a, c, t, g, unknown or other
  modified_base (268)..(269): a, c, t, g, unknown or other
  modified_base (271)..(272): a, c, t, g, unknown or other
  modified_base (276)..(284): a, c, t, g, unknown or other
  modified_base (293)..(294): a, c, t, g, unknown or other
  modified_base (297)..(297): a, c, t, g, unknown or other
  modified_base (301)..(303): a, c, t, g, unknown or other
  modified_base (305)..(306): a, c, t, g, unknown or other
  modified_base (309)..(310): a, c, t, g, unknown or other
  modified_base (315)..(317): a, c, t, g, unknown or other
  modified_base (322)..(322): a, c, t, g, unknown or other
  modified_base (324)..(331): a, c, t, g, unknown or other
  modified_base (333)..(335): a, c, t, g, unknown or other
  modified_base (339)..(339): a, c, t, g, unknown or other
  modified_base (341)..(342): a, c, t, g, unknown or other
  modified_base (345)..(346): a, c, t, g, unknown or other
  modified_base (348)..(348): a, c, t, g, unknown or other
  modified_base (357)..(357): a, c, t, g, unknown or other
  modified_base (360)..(361): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (374)..(375): a, c, t, g, unknown or other
  modified_base (377)..(378): a, c, t, g, unknown or other
  modified_base (384)..(384): a, c, t, g, unknown or other
  modified_base (394)..(645): a, c, t, g, unknown or other
  modified_base (720)..(720): a, c, t, g, unknown or other
  modified_base (770)..(770): a, c, t, g, unknown or other
  modified_base (837)..(837): a, c, t, g, unknown or other
  modified_base (864)..(864): a, c, t, g, unknown or other
  modified_base (876)..(876): a, c, t, g, unknown or other
  modified_base (900)..(900): a, c, t, g, unknown or other
  modified_base (1113)..(1113): a, c, t, g, unknown or other
  modified_base (1167)..(1167): a, c, t, g, unknown or other
  modified_base (1249)..(1254): a, c, t, g, unknown or other
nnnnnnnnnttcaataaattggcaattgaccaagtaaatgttaatggtaaacgagtcctcatgcgagtggattttaatgttccaataaagaatgggaaagttgcaaacaatttgcgcgtcgtctccgctttgcctacaattcaatatgccatatcgcatcaagcaaaannnntnntnttgnngagccanntgggangnccnnanggngaanntnnngannnnnnnnntntganaccngnnnntgannnnntgnnnnaattgctgnntnnannggtnnnnnnnnnggatgattnngtnggtnnngnngtnnaagcnnnagtcncnnnnnnnnannntggngnngtnntnttgcttganaanntncgnttccangnngnngaaganggcaaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggctgacaaaattcaattgatcaaaaaccttctgaacaaagtgaacgaaatgataatttgcgggggaatggcnttcactttcctcaaagtgatcgaccaaatgcaaattgggaattcactttntgatgaagagggtgcaaaaatagtgaaggaattaatggaggaggcaaagaagaagaatgtcaaagtncatttgccaattgattttgtggttggngatgaattcaangaaaatacggctcattccattgtngatgcaaaggccggaattccaggcggaaaaatgggactcgatattggaccggaaagtgcaaaaaaatttgcggatgtggtaaagaattcgaagacgattgtttggaatggaccagccggagtattcgaatgggacaattttgcagaagggacaaaagcattgttggactcggtggtggaagcaaccaaaaatggggcaaccacaataattggnggtggagacacggcaactgcctgcgagaaatggaatgcggatgataaagttagncatgttagcactggaggtggcgccagtttggaattattggagggcaaagtactccccggcgttgatgcactcacaaatgcannnnnn

SEQ ID NO: 979 - DNA, 1233 bp, Artificial Sequence
  Description of Artificial Sequence: Synthetic polynucleotide
  modified_base (1)..(108): a, c, t, g, unknown or other
  modified_base (360)..(360): a, c, t, g, unknown or other
  modified_base (442)..(1233): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttgttgccagacgagaattcgcatttattatgaaggacgactttcatttgcgttttttgtcattcaaaaatgtggccgaattcagggagagtttgcttaaattcaatccgcacaaaattgacatcggtgccatctacaatcgaccgccacgtgatcggaagaaggttggcgactttttcccatgtgaacgggagctggttttcgatattgatttgactgattacgatgttgtgcggaattgttgcggngatgcaaatatttgccagaaatgttggcgttggattacagtggcggtcaaagtgctggaattacttttacgcagtaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 980 - DNA, 6990 bp, Artificial Sequence
  Description of Artificial Sequence: Synthetic polynucleotide
  modified_base (1)..(57): a, c, t, g, unknown or other
  modified_base (162)..(162): a, c, t, g, unknown or other
  modified_base (226)..(495): a, c, t, g, unknown or other
  modified_base (621)..(621): a, c, t, g, unknown or other
  modified_base (831)..(831): a, c, t, g, unknown or other
  modified_base (888)..(888): a, c, t, g, unknown or other
  modified_base (908)..(908): a, c, t, g, unknown or other
  modified_base (939)..(939): a, c, t, g, unknown or other
  modified_base (957)..(957): a, c, t, g, unknown or other
  modified_base (966)..(966): a, c, t, g, unknown or other
  modified_base (1005)..(1005): a, c, t, g, unknown or other
  modified_base (1060)..(1143): a, c, t, g, unknown or other
  modified_base (1386)..(1386): a, c, t, g, unknown or other
  modified_base (1675)..(1839): a, c, t, g, unknown or other
  modified_base (1960)..(2094): a, c, t, g, unknown or other
  modified_base (2332)..(2532): a, c, t, g, unknown or other
  modified_base (2773)..(2931): a, c, t, g, unknown or other
  modified_base (3063)..(3063): a, c, t, g, unknown or other
  modified_base (3195)..(3195): a, c, t, g, unknown or other
  modified_base (3198)..(3198): a, c, t, g, unknown or other
  modified_base (3204)..(3204): a, c, t, g, unknown or other
  modified_base (3210)..(3210): a, c, t, g, unknown or other
  modified_base (3213)..(3213): a, c, t, g, unknown or other
  modified_base (3216)..(3216): a, c, t, g, unknown or other
  modified_base (3220)..(3221): a, c, t, g, unknown or other
  modified_base (3258)..(3258): a, c, t, g, unknown or other
  modified_base (3312)..(3312): a, c, t, g, unknown or other
  modified_base (3384)..(3384): a, c, t, g, unknown or other
  modified_base (3403)..(3870): a, c, t, g, unknown or other
  modified_base (4117)..(4323): a, c, t, g, unknown or other
  modified_base (4381)..(4383): a, c, t, g, unknown or other
  modified_base (4444)..(4446): a, c, t, g, unknown or other
  modified_base (4480)..(4482): a, c, t, g, unknown or other
  modified_base (4690)..(4704): a, c, t, g, unknown or other
  modified_base (4984)..(5340): a, c, t, g, unknown or other
  modified_base (5566)..(6147): a, c, t, g, unknown or other
  modified_base (6205)..(6207): a, c, t, g, unknown or other
  modified_base (6216)..(6216): a, c, t, g, unknown or other
  modified_base (6334)..(6864): a, c, t, g, unknown or other
  modified_base (6985)..(6990): a, c, t, g, unknown or other
nnnnnnnnnnnnnnnnnnnnnnnnnnnnnnnnnnnnnnnnnnnnnnnnnnnnnnnnnttggctgataaatcgaaaaaatggaagcaacttcaatcaaaacggtttgcagaaaagaggaagttcggttttgtcgattcacagaaggaagaaatgcctccagancatgttcgcaaaattatccgggaccatggtgacatgacttcacgcaaatatcgtcatgacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggattatgccgacaatattttggatgttgagccacttgaacccatccaaatggaattgaccgaagaggaagaaggccttgtcaaagattggttttacgattataaaccattggcccgaacaaanttcgtgaatggcgagtcctatcgcagttgggcattttcaatcccgatgatgtccaccctttatcgattggccaatcaattgctcactgatctgctggatgagaattatttctatttattcgatctcaaatcattcttcacggctaaagcgttgaatgttgcaatacctgggggaccaaaattcgaaccattgatacgggatacgaatcangacgaagattggaatgaattcaatgacatcaacaaagtgattattcgctccccaatncgaacggaatatcgcattgnattcccatttatgtacaacaatttgatcagngcattgccggttaccgtnaattggtancatactccgtcggttgtgttcatcaaaacagaggattangatttgccggcattctattttgatccacttatcaatccaattgcgcagaggaacnnnnnnnnnnnnnnnnnnnnnnnnnnnnnnnnnnnnnnnnnnnnnnnnnnnnnnnnnnnnnnnnnnnnnnnnnnnnnnnnnnnngaatttccactttatacggaaaatacggccaatggaatggcacttctttgggcacctcgtccattcaatattcgttccggacgaaccagacgaataatcgatgttcctttggtgaagagttggtacaaagaacattgcccagccgggatgccagtgaaagttcgtgtttcttatcaaaagctgctgaaagttttcgtcttgaatgctctcaaacatcgaccaccaaagcctcaaaagaaatgntaccttttccgttcattcaaaggcacaaaatttttccaatcaaccactctggattgggtcgaagttggtcttcaagttctccgccaaggctacaatatgttaaatctgttgattcatcgaaagaatttgaattatttacatttggattataacttcaatttgaagccagtcaaaacgctaacaaccaaagaacggaagaagtctcgtttcggaaatgcattccatttgtgccgtgaaattcttcgcctcaccaaattggttgtggatgcccacgttcaatatcggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaaggacctgggtgcggtatttgggcacccggctggcgtgtttggctcttctttcttcgcggaatcactccacttttggaacgatggttgggaaacttgctttcacgtcaattcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtcattttgcaacatttgagcgaagcatggcgttgttggaaggcaaatattccttggaaagtgccgggcctgccaaccccagttgaaaatatggttttgcgatatgtgaaagcaaaagctgattggtggaccaattccgctcattacaatcgcgaacgtgttcgtcgcggtgcaactgtggacaaaacagtgtgcaagaaaaatttgggccgtctcactcgtttatatttgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatcgactcaaccaaagccaacgggaggaattggcactgattgagcaagcctatgacaatccacatgaagcactctcccgaatcaaacgacacatgctaacaatgcgttcattcaaagaagtcggcattgaattcatggatttgtacagccatttggtgccggtctacgacattgaaccgctggagaaggtcaccgatgcctatttggatcaatatgtgtggtatgaatcggacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaatggatttgacgctgctgaaccggctgctccgtttgattgttgatcacaacattgccgactatatgacagccaaaaacaacgtaacaatcaattataaggacatgaaccatacaaattcatttganattattcgtggactgcaatttgcctcattcattgtccaatactatggattggtccttgatttgctggttcttggccttcgccgtgccagcgaaatttctggacctccacagtgtccaaatgaatttttggcnttngaaganatcacnacngangcannccatccaattcgtctctattgccgctacattgatcgngtttggattttcttccgcttcaattccgaagagaccagggatttgattcaacgntacctttcggagcatccggatccgaataatgaaaacattgttggttacaataacaaaaaatgctggcctcgngatgctcgaatgcgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaaattggtctcaattcaaaaatgccggctcgttttccgcctgttgttttctacacacccaaagaaattggtggacttggaatgctctcaatgggccatgtgctcattcctcaatccgatttgcgatggatgcgtcaaacggatgctggcggaatcacacattttcgcagtggaatgacccatgatgaggaccaaattattccaaatctttatcgttatattcaggtttggagttttaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaaatccattctggtggactcatcaacgacatgacggcaaattgtggaatttgnnnaactacagaacggatatgatccaagcattgggcgggtggaaggaattcttgaacaactctnnnttccggggcacctatttccccacttgggaaggtnnnttttgggaacgcgcatccggttttgaagaatcgatgaaattcaaaaaattgaccaatgcacaacgatctgggctgaatcaaattccaaatcgtcgattcacactttggtggtctccaacaatcaaccgagcaaatgtttatgttggtttccaagtgcaattggatcttaccggaatatttatgcatggtaaattgccaacattgaaannnnnnnnnnnnnnnatattccgagctcatttatggcaaaaaattcacgaatcggttgttatggatctttgtcaagttttcgacttggaattggatgctcttgaaattcaaacagtgcaaaaggaaacaatccatccaaggaaatcgtacaaaatgaacagttcttgtgccgacattctcctctttgcccaatacaaatggcatatttcgcgtccatcgctgttggccgataccaaagatgtgatggacaatacaaccacacaaaaattctggttggatgttcaacttcgttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtccattttttagactttcgaaggaaatttgaccacaaaaccaatgaatggggcaatcttcattttcaatcctcgaaccggtcaacttttcctcaaaattatccataccagcgtttgggctggacaaaaacgtctcagtcagttggctaaatggaaaaccgccgaagaagtggccgctttgattcgttcattgccagtggaagaacagcccagacaaattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacaaccagtaattatgagacgcaaacattttcatccaggaccgaatggcggtgcnnngcgatctgntcaacaaatctccatttgcgcacccaacacatttatgtgaattcggatgatgtgaaggacactggctacacatatattttgccaaaaaacattctcaaaaagttcatcacaatttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgtttggcagcaccaaaggaattttaccatgaagatcatcgaccactgcatttccacaatttcaatgtgcttgaagatccgctgggagtggcaaccgccgatcgagaagatatattcnnnnnn

SEQ ID NO: 981 - DNA, 1014 bp, Artificial Sequence
  Description of Artificial Sequence: Synthetic polynucleotide
  modified_base (123)..(123): a, c, t, g, unknown or other
  modified_base (175)..(417): a, c, t, g, unknown or other
  modified_base (631)..(1014): a, c, t, g, unknown or other
atgggaaaaacatccaaagataaacgtgatatttattatcgattggccaaaaccgaaggttttcgggcacattccgcctttaaattgatgcaaattgacgagaattttcacatttttcaagtngtgaccaaagcggttgatctttgtgcagcaccgggttcatggagtcaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttcaacattacttcattcattttggctaaaggtggaatattcatctcaaagattttccgagccaaaaacatcaatcttctctatgcccaaatgaagcaattcttcaaggaagtggattgttgcaagccaaaaagtagtcgccaatcaagttgtgaggcattcattgtttgccggggctatcaaccaccgcctggctatgaaccgaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 982 - DNA, 978 bp, Artificial Sequence
  Description of Artificial Sequence: Synthetic polynucleotide
  modified_base (1)..(474): a, c, t, g, unknown or other
  modified_base (586)..(588): a, c, t, g, unknown or other
  modified_base (619)..(621): a, c, t, g, unknown or other
  modified_base (964)..(978): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgttcgcttctctccatccaaccaaaatccggtcatcgtttctgctggatgggacaaagtggtgaaagtgtggaacttggcaacttgtcgcctcaaaaccaaccatattnnncatacgggctacatcaattcggtcactgttnnncccgatggttcgctttgtgcttccggtggaaaggacggatcggcaatgctttgggatcttaatgagggcaaacatctctacacgttgggaggcaatgatgtgatcaattcgcttgcattctctccaaatcgctattggctctgtgccgccgttggaccagttgtgaagatttgggaccttgaggacaaaaccattgttgatgaactgaagctggacatcgcaagtacaagtaccacaaagaaatcggcaccgcaatgcacttcacttgcttggtcatccgatggacaaacactctttgttggctatacggacaatatcattcgtgtgtggcgcgtttccgtcnnnnnnnnnnnnnnn

SEQ ID NO: 983 - DNA, 402 bp, Artificial Sequence; identical to SEQ ID NO: 645
  Description of Artificial Sequence: Synthetic polynucleotide
  modified_base (1)..(36): a, c, t, g, unknown or other
  modified_base (283)..(283): a, c, t, g, unknown or other
  modified_base (285)..(286): a, c, t, g, unknown or other
  modified_base (289)..(292): a, c, t, g, unknown or other
  modified_base (394)..(402): a, c, t, g, unknown or other

SEQ ID NO: 984 - DNA, 333 bp, Artificial Sequence
  Description of Artificial Sequence: Synthetic polynucleotide
  modified_base (1)..(69): a, c, t, g, unknown or other
  modified_base (331)..(333): a, c, t, g, unknown or other
nnnnnnnnnnnnnnnnnnnnnnnnnnnnnnnnnnnnnnnnnnnnnnnnnnnnnnnnnnnnnnnnnnnnnttttaggtgaagaagtggaatgcagttgcattatgggcctgggacatagttgttgacacttgtgccatatgccgcaaccatatcatggatttgtgcattgaatgccaagcaaaccaagcatcatcaaccaatgaggaatgcactgtcgcttggggggtctgcaatcatgccttccacttccattgcatctcgcgttggctccgtactcgacaggtttgcccactcgacaaccgtgattgggacttccagaaatatggacatnnn

SEQ ID NO: 985 - DNA, 576 bp, Artificial Sequence
  Description of Artificial Sequence: Synthetic polynucleotide
  modified_base (1)..(267): a, c, t, g, unknown or other
  modified_base (351)..(351): a, c, t, g, unknown or other
  modified_base (415)..(462): a, c, t, g, unknown or other
  modified_base (574)..(576): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgatgatggtccggttttgcctaaaagcaacagtgaagaatttcgaccattcatgcgccgtctacccgaattcaaattttgnttatctacaatgaaatccacactcattgcgttcacatgcactttctttgaagtgttcgacattnnnnnnnnnnnnnnnnnnnnnnnnnnnnnnnnnnnnnnnnnnnnnnnnttgaccatgaaacgccaaattatgcacatgatccgttatcgttacattccattcaccacgggcaaaccacgaccacaaggaagaagcgacaatggcaaagtagttatgggannn

SEQ ID NO: 986 - DNA, 1005 bp, Artificial Sequence
  Description of Artificial Sequence: Synthetic polynucleotide
  modified_base (1)..(36): a, c, t, g, unknown or other
  modified_base (148)..(228): a, c, t, g, unknown or other
  modified_base (255)..(255): a, c, t, g, unknown or other
  modified_base (459)..(459): a, c, t, g, unknown or other
  modified_base (733)..(1005): a, c, t, g, unknown or other
nnnnnnnnnnnnnnnnnnnnnnnnnnnnnnnnnnnnatcgaaaaatatcgtccaagaacacttgatgatgttatcggcaatacggaaacaataaaacgtttgaaagcattgacacggacgggcaatattccaaacttaataatctcgnnnnnnnnnnnnnnnnnnnnnnnnnnnnnnnnnnnnnnnnnnnnnnnnnnnnnnnnnnnnnnnnnnnnnnnnnnnnnnnnnttggagctgaatgcaagtgacgaaagnggtattgacatagttcgagaacgcataaagcgatttgcttctacgaaagttactttgcctccaaatgcgcaaaagatagtcattttggatgaggctgatagcatgacagaaggagcccaacaagcattacgtcgaatcatggaggtttatagtgcaacaacaagatttgctttcgcatgcaatcaatcggacaaaatattgganccgctacaatctcgatgtgcaattatcaaattttccaaagtggaggaaaaggaaattttgaaaagattgcagcatatttgcgatttggaaaaaattcaattcactggggatggtttgatggcaattttgtacacatcacaaggggacatgagacaagctttaaataacatgcaatgcacggtttcaagctatggaatgattaagaaggaatttgtttacaacgtgtgtgatgagccgcatccaacaaaaattgccgaaatttttgagcattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 987 - DNA, 1065 bp, Artificial Sequence
  Description of Artificial Sequence: Synthetic polynucleotide
  modified_base (1)..(6): a, c, t, g, unknown or other
  modified_base (40)..(48): a, c, t, g, unknown or other
  modified_base (300)..(300): a, c, t, g, unknown or other
  modified_base (370)..(399): a, c, t, g, unknown or other
  modified_base (589)..(1065): a, c, t, g, unknown or other
nnnnnnctttgggtcgacaaatacaggcctacggatttgnnnnnnnnnacaaaattaacatatcacaaaagtcaagcagagaagttgaccaaattaaaacatcggcgatttcccacattattgttttgtgggccaaatggagttggaaaacggactcgaatccaatgtttgttgaagaaaatatacggaagtggtgttggcaaagttcacgtcgaagaacaccaatttcaaacagccaatgggaaaaagctaacaatcaatgttgttaacagcaattatcacatggaattaacaccatgngatgttggcatttatgatcgagttttggtgcaggatgtgatcaaagaaatggcacaagtgcaacaattgnnnnnnnnnnnnnnnnnnnnnnnnnnnnnnattgttttgatggaagcagagaatttgaccaaggaggcccaacattcattgcgccggacgatggaaaaatatgcggccacatgcaaaattattctctgctgtgaatcggcgagtcgaataattgaaccattgcgaagtcgatgtatgatattccacgtttcggcaccaaatgatgatgaggttacccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 988 - DNA, 576 bp, Artificial Sequence
  Description of Artificial Sequence: Synthetic polynucleotide
  modified_base (1)..(255): a, c, t, g, unknown or other
  modified_base (387)..(387): a, c, t, g, unknown or other
  modified_base (474)..(474): a, c, t, g, unknown or other
  modified_base (574)..(576): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggatggtgattttacattcgtcatcaaagagggttgcacctacaaaattcgattcgagttccatgtccagagagaaattgtcgccggccttaaatatcttcataaagtgaccagacttggcattggatcnacaaaggaatgttacatgttgggatcatttgggccgaggcaagaaatttacatttatgacacaccggcagaggaagcgccttcaganatgttgagtcgcggaaaatacaaagtgcgttcccttatttcggatgacgacaagaaccgatggctggaatggagctggaatattgaaattaacaaggacnnn

SEQ ID NO: 989 - DNA, 2367 bp, Artificial Sequence
  Description of Artificial Sequence: Synthetic polynucleotide
  modified_base (1)..(21): a, c, t, g, unknown or other
  modified_base (289)..(468): a, c, t, g, unknown or other
  modified_base (550)..(582): a, c, t, g, unknown or other
  modified_base (913)..(915): a, c, t, g, unknown or other
  modified_base (1029)..(1029): a, c, t, g, unknown or other
  modified_base (1141)..(1392): a, c, t, g, unknown or other
  modified_base (1531)..(1728): a, c, t, g, unknown or other
  modified_base (1920)..(1920): a, c, t, g, unknown or other
  modified_base (1926)..(1926): a, c, t, g, unknown or other
  modified_base (2254)..(2367): a, c, t, g, unknown or other
nnnnnnnnnnnnnnnnnnnnntatgtagttaaacgtgatggccgcaaagaggaagtgaatccagagaaaattacatctcgtgtgaccaaactatgctatgggctcgatatgaattacataaatccgaatcacatcacggcaaaagcagccagtggaatttacaagggcgtgactactgttgaattggacaatttggcagcagaggtggctgcctcaatgacaacaatgcaccccgattatgcactattagccgccagaattgccatttcaaatcttcataaagagactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaacgttcctatctgcttcgaatcaacggcaaagtggtggaaaggccgcagcatatgttaatgcgagttgcattgggannnnnnnnnnnnnnnnnnnnnnnnnnnnnnnnnacgtacaatctaatgtcggaacgatggttcacacatgcatcgcccaccctcttcaacgcgggcacctgtcattcccaactgtcttcatgctttcttttgcccagtcccgatgattcaatggaaggcatttgcaaaacgctcacggattgtgcactcatttccaaatctgccgggggcattggcttcagtgtccataacattcgctcatttggcactcgaattcgcacgacgaaaggaacttcaaatggaattgtgccaatgcttcgtgtatacaataatatgtcacgctatgttgatcaaggcgggaataaacgtcccggtgcttatgcgnnntatttggagccatggcactccgacatcatggaatttctggaaatgcgactgaacaatggttgcgaagaattgcgcgcccgggacttttttatgctctttggatacccgatccgnttcatgaaacgcgtaaaagaagacaaatattggtcgctgatgtgtccaaaaaaatcgcctggattggccaattgttggggcgaaaaattcgagaaactttacaccaagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacattatgattttgagcagttgaaggaagtgaccaaagtggtgacacgaaatttgaacaaaatcatcgacgtaaactactatccgattcgagaggccgagaactctaacaagcgacatcgccccattggaattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggcgtcgaaccaaccggtctctgggattgggcagcattgaaggctaaaattgcccaatatggggtgcgtaacagcttattgattgcgccaatgcccacagcctcaactgcacaaattttgggcaacaatgaatccattgagccatacacttcaaacatttacagtcgacgcgtgctgtccggtgatttncaggtngcgaatccgcatttaatgaaggatttgatcgaattgaacctttgggatgatcaaatgcgccaacgacttatttccgaaagtggttctgttcaaaacattccacaattgccgaccgaaatcaaagaattgtataaaacggtttgggagataccgcaaaaggaagttctgcatatggccgctgatcgggccgccttcatcgatcaaagtcaatcattgaatttgcatattgccgagccaacatatgccaaacttacttcaatgcatttttatgcctggcaattgggactaaaaaccgggatgtactatttgcgtactcgaccagccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 990 - DNA, 939 bp, Artificial Sequence
  Description of Artificial Sequence: Synthetic polynucleotide
  modified_base (147)..(147): a, c, t, g, unknown or other
  modified_base (346)..(348): a, c, t, g, unknown or other
  modified_base (937)..(939): a, c, t, g, unknown or other
atggggcgagaagacagaacaacatggaaagccaattatttcaccagaattatcaacctttttgacgagtacccaaaatgtcttctggtcggtgttgacaatgttggatcgaaacaaatgcaagaaattcgtcaagcaatgcgagancatggtgaaattttgatgggcaaaaacacaatgattcgtaaagcaattcgtggccacctatccaagaatcctcttcttgaaaaacttctgccttacattgtcggcaatgtgggatttgtcttcaccaatgaggatttgggagacattcgtaagaagctattggagaacaaacgaggagcaccagctaaagccggggcgnnngcaccttgcgatgttagactcgaaccacagaacacgggaatgggcccagagaagacttcattcttccaagcattgcaaattccaacaaaaatttcgcgaggaacaattgaaattttgaatgaggttcatatcatcaaggtgggcgagaaagtcggtgcttctgaggctgctttgctcaacatgttgaacatccaaccattctcttatggacttgccgtgcaacaggtgtatgacgctggtgcgatttactcgcccgaagtgcttgatgtgacccaagacgatcttcgtgcccgtttcatgcaaggagttgcaacggttgctgctgtttcgctgggaattggctatccgacaaaggcttcggcaccgcatctcgttgccaacgttttcaaacgattgttggctgttgccgccgagacggaagtcacattcaaagaagctgagaagatcaaagaatatttggctgacccatcgaaatttgccgcagctgttgccgcatctgcaccaccaaccgcagccgcagccactccggcaaagaaggaagaagaaaaagaagaatcggatgaggacatgggctttggcttatttgacnnn

SEQ ID NO: 991 - DNA, 369 bp, Artificial Sequence; identical to SEQ ID NO: 667
  Description of Artificial Sequence: Synthetic polynucleotide
  modified_base (141)..(141): a, c, t, g, unknown or other
  modified_base (283)..(369): a, c, t, g, unknown or other

SEQ ID NO: 992 - DNA, 636 bp, Artificial Sequence
  Description of Artificial Sequence: Synthetic polynucleotide
  modified_base (1)..(138): a, c, t, g, unknown or other
  modified_base (168)..(168): a, c, t, g, unknown or other
  modified_base (179)..(180): a, c, t, g, unknown or other
  modified_base (184)..(184): a, c, t, g, unknown or other
  modified_base (186)..(186): a, c, t, g, unknown or other
  modified_base (189)..(194): a, c, t, g, unknown or other
  modified_base (199)..(200): a, c, t, g, unknown or other
  modified_base (202)..(202): a, c, t, g, unknown or other
  modified_base (204)..(207): a, c, t, g, unknown or other
  modified_base (353)..(354): a, c, t, g, unknown or other
  modified_base (357)..(359): a, c, t, g, unknown or other
  modified_base (361)..(361): a, c, t, g, unknown or other
  modified_base (363)..(364): a, c, t, g, unknown or other
  modified_base (373)..(373): a, c, t, g, unknown or other
  modified_base (376)..(377): a, c, t, g, unknown or other
  modified_base (380)..(380): a, c, t, g, unknown or other
  modified_base (382)..(382): a, c, t, g, unknown or other
  modified_base (384)..(384): a, c, t, g, unknown or other
  modified_base (421)..(421): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (451)..(492): a, c, t, g, unknown or other
  modified_base (628)..(636): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaggccaagcgagaaaagaccagccagnaatgatttgannattntngtnnnnnncaatnntnannnngcagatcaaatgtacgtattcttcccggacgatccaaaaattggcatcaaagtgatcaaacaaatttgtcaacaaatgcaggagcaaaacatcacccgggccatcattgtcgttcaaactggaatgacaccgtccgcaaaacaggnnatnnncnanntggcacccnaanncanantngaacattttttggaggccgaattgatggtgaacatcncngancangaattggtgccagaacatgttnnnnnnnnnnnnnnnnnnnnnnnnnnnnnnnnnnnnnnnnnnaaactgaaggagaatcaattgccgcgcattcaaatcagtgacccagtggcccgttattttggtttgcgccgtggccaagtcgtcaaaatcattcgaccttccgaaaccgccggccgctacatttcctatcgacttnnnnnnnnn

SEQ ID NO: 993 - DNA, 414 bp, Artificial Sequence
  Description of Artificial Sequence: Synthetic polynucleotide
  modified_base (1)..(168): a, c, t, g, unknown or other
  modified_base (412)..(414): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaccaaccgagtgaccaccccattcatgaccaaatatgaacgagcccgtgtgcttggcaccagggcattacaaattgcgatgggcgctccggtgatggtggagacggagggcgaaactgatccattggaaattgctaggaaagaattgaaggaacaaaaaatcccaataatcattcgacgctatttgcccgacggttcattcgaggattgggcaattgatgagttaacaattacggattggnnn

SEQ ID NO: 994 - DNA, 447 bp, Artificial Sequence
  Description of Artificial Sequence: Synthetic polynucleotide
  modified_base (1)..(6): a, c, t, g, unknown or other
  modified_base (33)..(33): a, c, t, g, unknown or other
  modified_base (75)..(75): a, c, t, g, unknown or other
  modified_base (88)..(96): a, c, t, g, unknown or other
  modified_base (133)..(267): a, c, t, g, unknown or other
  modified_base (358)..(447): a, c, t, g, unknown or other
nnnnnnaatatttattttgaggatttattcacngtcaaaaatgttgatcccgatggaaagaagttcgacagagtnaaccgatttttcnnnnnnnnngaatcatttaaaatggatctcattttggacataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatgtatggcaaaatctatcggattgagggagatgatagctcaacagaaacaagtcgattggcggcatatgcctcatttggtggccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 995 - DNA, 624 bp, Artificial Sequence; identical to SEQ ID NO: 618
  Description of Artificial Sequence: Synthetic polynucleotide
  modified_base (334)..(624): a, c, t, g, unknown or other

SEQ ID NO: 996 - DNA, 489 bp, Artificial Sequence
  Description of Artificial Sequence: Synthetic polynucleotide
  modified_base (1)..(81): a, c, t, g, unknown or other
  modified_base (265)..(489): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnngtcttcaaattttgccgctccaaatgcaacaaattgttcaagaagaagaagaatccgcgcaaattgaaatggacaaaagcctctcgccgtttgcggggcaaagaactcgtgaatgatgccacccaagcattggaggttcgccggaatgagccgaccaaatacgatagggcactttggaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 997 - DNA, 213 bp, Artificial Sequence
  Description of Artificial Sequence: Synthetic polynucleotide
  modified_base (1)..(51): a, c, t, g, unknown or other
  modified_base (184)..(213): a, c, t, g, unknown or other
nnnnnnnnnnnnnnnnnnnnnnnnnnnnnnnnnnnnnnnnnnnnnnnnnnnaaggatgccaaatccgtgaagatcaagaaaaaccgtgagaacaccaaattcaaggttcgctgcagcaaattcctttatacgctggtcgtcgaggacaaagaaaaggccgagaaactcaaacaatctttgccgnnnnnnnnnnnnnnnnnnnnnnnnnnnnnn

SEQ ID NO: 998 - DNA, 939 bp, Artificial Sequence; identical to SEQ ID NO: 418
  Description of Artificial Sequence: Synthetic polynucleotide
  modified_base (1)..(399): a, c, t, g, unknown or other
  modified_base (937)..(939): a, c, t, g, unknown or other

SEQ ID NO: 999 - DNA, 1473 bp, Artificial Sequence
  Description of Artificial Sequence: Synthetic polynucleotide
  modified_base (1)..(192): a, c, t, g, unknown or other
  modified_base (379)..(379): a, c, t, g, unknown or other
  modified_base (381)..(381): a, c, t, g, unknown or other
  modified_base (721)..(723): a, c, t, g, unknown or other
  modified_base (862)..(1107): a, c, t, g, unknown or other
  modified_base (1270)..(1473): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccattgaatcacttcaacaattggagaagaaaagccgtctggactgcgacatgaagtcaaatatgcgcattgctcgtcacatgatcaagttggcgtttgatgcaaagcaatgggacctgctcaatgacacaatcaaaacactttgcaagaagagagcactcatcaaaatgagcatcaaaacaatgntncaagatgcctgcgaaatgattgatcaaacgccaaatgaagctgtcaaagcgaaactgattgagaatttgcgtatcgtcactgctggaaagatctatgtggaagtggagcgagccagattgacaaagctggtggcggacaaattggaagtggaaggcaaattggacgaggccagagagctcattatggaattgcaagtggagacgtatggatcgatggaagtcaatgagaaggtccaatatttgctccatcaaatgcgcctctcaattgccaagcaggacttcacaagggccacaatcatttcgcggaaaatcagcgccaaattctttgagcgtgcgggcnnngatgaggttcaactgatgaaattggaattctacaaatatatggtgcaagttggtctgcaggatgaggcatatttggatgtttgcaaacacttcttggccattttcaacacgcccagcatcaaagcggatgaggcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgccgagggccaaaaacgcaaagaacggcttcatgattgcgtcggggagcacaatgttcgaatgattgccaaatactacactcgaatcacattcaagcgaatggccgaattgctggaattcgacgttgaccaaatggaagcatttgtgtgcaaattgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1000 - DNA, 1317 bp, Artificial Sequence
  Description of Artificial Sequence: Synthetic polynucleotide
  modified_base (1)..(660): a, c, t, g, unknown or other
  modified_base (850)..(1317): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaggctaaattggaccttcaatccgggattttgcatgccgccgacgaccgcgacttcaaaaccgcattctcctacttctacgaggcattcgaggctttcgactcctccagtgaccaaagaatggcacaattggccctcaaatatatgttactgagcaaaattatgaccgacaatttggacgaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1001 - DNA, 1233 bp, Artificial Sequence
  Description of Artificial Sequence: Synthetic polynucleotide
  modified_base (1)..(174): a, c, t, g, unknown or other
  modified_base (179)..(179): a, c, t, g, unknown or other
  modified_base (234)..(234): a, c, t, g, unknown or other
  modified_base (243)..(243): a, c, t, g, unknown or other
  modified_base (331)..(375): a, c, t, g, unknown or other
  modified_base (724)..(798): a, c, t, g, unknown or other
  modified_base (1228)..(1233): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcanggacaacgaaatgggaccattctatgagcaagcctgcaaacaagtgaacatgaanattgatgcngcattgctggaccaattcaaagcgaaaaacaaagctcgattggacgaaattgacaagcaaattgaggatgcggagaaaaatttgggtnnnnnnnnnnnnnnnnnnnnnnnnnnnnnnnnnnnnnnnnnnnnntgcaaaattggggacaaaacaaatgcagttgaggcattcggaaaaactttcgacaaaactgtgggcgttggctatcgcatcgatttggtgttcaatttaatccgaattggccttttcttcatggatcacgaattgattaccacaaatattgaaaaggcaaaggaactgatggaaaagggaggcgattgggaccgcaaaaaccgactccgttcgtatgaaggactttacaaaatggccattcgcgacatgaaaggagcggctgaacttttcctggaagcagtgccaacattcggagcatacgaattgatgaattacgaggatttgattttttacaccgtcgtcacttccnnnnnnnnnnnnnnnnnnnnnnnnnnnnnnnnnnnnnnnnnnnnnnnnnnnnnnnnnnnnnnnnnnnnnnnnnnnggtgaaaataacgcgaatctcccgttggccaaaaatctgttgaacacattcttcgcctccgaatatgacaaatttttggttgcattggccaaattggagagggatgttctcctgcatgatcgttatttgaagccacattgccaattttacacacgggcaatgcgcgtcaaagcctatcaacaattcttggctccttataaatcggtcaaattggatacgatggcagcaagttttggtgttacgaaggattatttggagcaacaattgttcaccttcatttcctctggactgctcagttgccgaattgatggttgccagggagtggtggaaatggcccaaactgaccacaaaaatcaactctacaagaaattgctccatgatggcgacattctcctcaatcgagtccaaaaattgtcgcgagtgatcaatnnnnnn

SEQ ID NO: 1002 - DNA, 1089 bp, Artificial Sequence; identical to SEQ ID NO: 528
  Description of Artificial Sequence: Synthetic polynucleotide
  modified_base (1)..(117): a, c, t, g, unknown or other
  modified_base (265)..(432): a, c, t, g, unknown or other
  modified_base (631)..(1089): a, c, t, g, unknown or other

SEQ ID NO: 1003 - DNA, 1164 bp, Artificial Sequence
  Description of Artificial Sequence: Synthetic polynucleotide
  modified_base (1)..(429): a, c, t, g, unknown or other
  modified_base (706)..(1164): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgaggagaccgaacagaaattgaaccgtctggttgaagttggcccggtgcatgctgcattttataaagtctcagcggcctatcaacgtcaaattggcgattatgctcgttattatacggaagcattgcgctatttgggatgcgaagatttggacaactttctggtggaagagcgaattcagcatgcattgttgctttgtgtggcagcacttttgggcaaaggaatttacaattttggggaattgttggctcatccaattttgcaagcacttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1004 - DNA, 456 bp, Artificial Sequence
  Description of Artificial Sequence: Synthetic polynucleotide
  modified_base (148)..(150): a, c, t, g, unknown or other
  modified_base (214)..(456): a, c, t, g, unknown or other
atgggtcgtatgcacaatccaggaaagggaatttcccgctccgcacttccctatcgtcgttcggtgcccacttggcagaagctgaccagccaagatgttgaggaacaaatcgtcaaatggcgcgcaaaggacatcttccatccaaatnnnggtgtgctgctccgtgactcccatggtgtggctcaagtgcgccgtatcactggcaacaagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1005 - DNA, 1308 bp, Artificial Sequence; identical to SEQ ID NO: 429
  Description of Artificial Sequence: Synthetic polynucleotide
  modified_base (42)..(42): a, c, t, g, unknown or other
  modified_base (46)..(46): a, c, t, g, unknown or other
  modified_base (48)..(48): a, c, t, g, unknown or other
  modified_base (54)..(54): a, c, t, g, unknown or other
  modified_base (60)..(60): a, c, t, g, unknown or other
  modified_base (66)..(66): a, c, t, g, unknown or other
  modified_base (72)..(72): a, c, t, g, unknown or other
  modified_base (78)..(78): a, c, t, g, unknown or other
  modified_base (189)..(189): a, c, t, g, unknown or other
  modified_base (236)..(237): a, c, t, g, unknown or other
  modified_base (241)..(241): a, c, t, g, unknown or other
  modified_base (248)..(248): a, c, t, g, unknown or other
  modified_base (255)..(256): a, c, t, g, unknown or other
  modified_base (347)..(349): a, c, t, g, unknown or other
  modified_base (356)..(357): a, c, t, g, unknown or other
  modified_base (365)..(365): a, c, t, g, unknown or other
  modified_base (367)..(367): a, c, t, g, unknown or other
  modified_base (370)..(370): a, c, t, g, unknown or other
  modified_base (408)..(408): a, c, t, g, unknown or other
  modified_base (423)..(423): a, c, t, g, unknown or other
  modified_base (429)..(429): a, c, t, g, unknown or other
  modified_base (440)..(441): a, c, t, g, unknown or other
  modified_base (447)..(447): a, c, t, g, unknown or other
  modified_base (450)..(450): a, c, t, g, unknown or other
  modified_base (453)..(456): a, c, t, g, unknown or other
  modified_base (473)..(473): a, c, t, g, unknown or other
  modified_base (477)..(477): a, c, t, g, unknown or other
  modified_base (483)..(483): a, c, t, g, unknown or other
  modified_base (486)..(486): a, c, t, g, unknown or other
  modified_base (499)..(499): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (531)..(531): a, c, t, g, unknown or other
  modified_base (543)..(543): a, c, t, g, unknown or other
  modified_base (549)..(549): a, c, t, g, unknown or other
  modified_base (559)..(559): a, c, t, g, unknown or other
  modified_base (570)..(570): a, c, t, g, unknown or other
  modified_base (588)..(588): a, c, t, g, unknown or other
  modified_base (595)..(595): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (666)..(666): a, c, t, g, unknown or other
  modified_base (675)..(676): a, c, t, g, unknown or other
  modified_base (678)..(678): a, c, t, g, unknown or other
  modified_base (684)..(684): a, c, t, g, unknown or other
  modified_base (726)..(726): a, c, t, g, unknown or other
  modified_base (804)..(811): a, c, t, g, unknown or other
  modified_base (813)..(813): a, c, t, g, unknown or other
  modified_base (815)..(820): a, c, t, g, unknown or other
  modified_base (822)..(822): a, c, t, g, unknown or other
  modified_base (825)..(825): a, c, t, g, unknown or other
  modified_base (828)..(828): a, c, t, g, unknown or other
  modified_base (830)..(830): a, c, t, g, unknown or other
  modified_base (837)..(837): a, c, t, g, unknown or other
  modified_base (840)..(840): a, c, t, g, unknown or other
  modified_base (852)..(852): a, c, t, g, unknown or other
  modified_base (855)..(855): a, c, t, g, unknown or other
  modified_base (862)..(863): a, c, t, g, unknown or other
  modified_base (871)..(873): a, c, t, g, unknown or other
  modified_base (918)..(918): a, c, t, g, unknown or other
  modified_base (927)..(927): a, c, t, g, unknown or other
  modified_base (936)..(942): a, c, t, g, unknown or other
  modified_base (946)..(946): a, c, t, g, unknown or other
  modified_base (949)..(951): a, c, t, g, unknown or other
  modified_base (957)..(957): a, c, t, g, unknown or other
  modified_base (969)..(969): a, c, t, g, unknown or other
  modified_base (981)..(981): a, c, t, g, unknown or other
  modified_base (990)..(990): a, c, t, g, unknown or other
  modified_base (1008)..(1008): a, c, t, g, unknown or other
  modified_base (1014)..(1014): a, c, t, g, unknown or other
  modified_base (1029)..(1029): a, c, t, g, unknown or other
  modified_base (1048)..(1048): a, c, t, g, unknown or other
  modified_base (1053)..(1053): a, c, t, g, unknown or other
  modified_base (1056)..(1056): a, c, t, g, unknown or other
  modified_base (1061)..(1062): a, c, t, g, unknown or other
  modified_base (1071)..(1071): a, c, t, g, unknown or other
  modified_base (1086)..(1086): a, c, t, g, unknown or other
  modified_base (1095)..(1095): a, c, t, g, unknown or other
  modified_base (1107)..(1107): a, c, t, g, unknown or other
  modified_base (1110)..(1110): a, c, t, g, unknown or other
  modified_base (1113)..(1113): a, c, t, g, unknown or other
  modified_base (1117)..(1117): a, c, t, g, unknown or other
  modified_base (1119)..(1119): a, c, t, g, unknown or other
  modified_base (1126)..(1126): a, c, t, g, unknown or other
  modified_base (1140)..(1140): a, c, t, g, unknown or other
  modified_base (1146)..(1146): a, c, t, g, unknown or other
  modified_base (1149)..(1149): a, c, t, g, unknown or other
  modified_base (1152)..(1152): a, c, t, g, unknown or other
  modified_base (1155)..(1155): a, c, t, g, unknown or other
  modified_base (1159)..(1159): a, c, t, g, unknown or other
  modified_base (1161)..(1161): a, c, t, g, unknown or other
  modified_base (1164)..(1164): a, c, t, g, unknown or other
  modified_base (1167)..(1167): a, c, t, g, unknown or other
  modified_base (1173)..(1173): a, c, t, g, unknown or other
  modified_base (1185)..(1185): a, c, t, g, unknown or other
  modified_base (1194)..(1195): a, c, t, g, unknown or other
  modified_base (1200)..(1200): a, c, t, g, unknown or other
  modified_base (1279)..(1308): a, c, t, g, unknown or other

SEQ ID NO: 1006 - DNA, 1377 bp, Artificial Sequence; identical to SEQ ID NO: 594
  Description of Artificial Sequence: Synthetic polynucleotide
  modified_base (1)..(315): a, c, t, g, unknown or other
  modified_base (420)..(420): a, c, t, g, unknown or other
  modified_base (876)..(876): a, c, t, g, unknown or other
  modified_base (1074)..(1074): a, c, t, g, unknown or other
  modified_base (1177)..(1377): a, c, t, g, unknown or other

SEQ ID NO: 1007 - DNA, 1347 bp, Artificial Sequence; identical to SEQ ID NO: 563
  Description of Artificial Sequence: Synthetic polynucleotide
  modified_base (588)..(588): a, c, t, g, unknown or other
  modified_base (712)..(822): a, c, t, g, unknown or other
  modified_base (1081)..(1347): a, c, t, g, unknown or other

SEQ ID NO: 1008 - DNA, 582 bp, Artificial Sequence
  Description of Artificial Sequence: Synthetic polynucleotide
  modified_base (1)..(153): a, c, t, g, unknown or other
  modified_base (465)..(465): a, c, t, g, unknown or other
  modified_base (580)..(582): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctccatccaacttccgaagaactctcacttggcggaattcgattcactacattcgacttgggcggtcacgtccaggctcgacgcgtttggaaaagttattttccagcattggatgccatcgtctttctggtggatgtggccgatttggaacgcattcaagaagccagagaagaactgtggagtttgatgcaggatgaacaggtgtcggccgccccaatcctcattttgggcaacaaaattgacaaaccgaatgcactcagcgaggatcagcttaaatattatttgagcattcagcaacattgtacagcnaaaggcaatgtgtctcgagccgatttggccactcgcccattggaagtgttcatgtgctctgttctacgtcgacaaggctatggcgaaggatttcgttggctttcccaatatttgnnn

SEQ ID NO: 1009 - DNA, 897 bp, Artificial Sequence
  Description of Artificial Sequence: Synthetic polynucleotide
  modified_base (1)..(126): a, c, t, g, unknown or other
  modified_base (330)..(330): a, c, t, g, unknown or other
  modified_base (442)..(582): a, c, t, g, unknown or other
  modified_base (693)..(693): a, c, t, g, unknown or other
  modified_base (859)..(897): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcaactacctcggttcatgggccaaatgtgaaaactttcgaaatttaccgttacaatccggaaacgccaaatgtaaagccccatttacagaaatatgacattgatttggataaatgcggaccgatggtattggatgcccttataaaaatcaaaaatgaagttgatccaaccttgacttttcgccgttcttgcagagaagtnatttgcggttcatgttcaatgaatattaatggggaaaatacactggcatgcatctgtcatattgacaaaaatacttcaaaatcaacaaaaatctatccattaccccatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggactctatgaatgcattttatgcgcgtgctgcagtacttcttgcccctcttattggtggaatccggacaaataccttggccctgcggcacttttgcaatcatatagntggataatcgattccagggatgacaaagtccaggaacgtctttcccgtttgaccgatccattcagtgccttcaaatgtcatacaattctgaattgcacaaaaacatgccctaaacatttaaatccggcaaaggcaattggcgaaatcaaaaaattattgatgggcnnnnnnnnnnnnnnnnnnnnnnnnnnnnnnnnnnnnnnn

SEQ ID NO: 1010 - DNA, 276 bp, Artificial Sequence
  Description of Artificial Sequence: Synthetic polynucleotide
  modified_base (1)..(33): a, c, t, g, unknown or other
  modified_base (84)..(84): a, c, t, g, unknown or other
  modified_base (87)..(87): a, c, t, g, unknown or other
  modified_base (91)..(91): a, c, t, g, unknown or other
  modified_base (102)..(102): a, c, t, g, unknown or other
  modified_base (129)..(129): a, c, t, g, unknown or other
  modified_base (138)..(138): a, c, t, g, unknown or other
  modified_base (142)..(142): a, c, t, g, unknown or other
  modified_base (162)..(162): a, c, t, g, unknown or other
  modified_base (174)..(175): a, c, t, g, unknown or other
  modified_base (190)..(190): a, c, t, g, unknown or other
  modified_base (195)..(195): a, c, t, g, unknown or other
  modified_base (271)..(276): a, c, t, g, unknown or other
nnnnnnnnnnnnnnnnnnnnnnnnnnnnnnnnngcggaatacattaaattgaaagtggttggccaggattccaatgaagtccanttncgantgaaatatggnaccagcatgggcaaattgaagaaggcntacgcagancgcnctggagtcacggtcggttcnctacgcttcctnntcgatggtcgccggnttaangatgatgacactcccaaaagcttggaaatggaagaggatgataccattgaggtttaccaagaacagatgggtggcnnnnnn

SEQ ID NO: 1011 - DNA, 357 bp, Artificial Sequence
  Description of Artificial Sequence: Synthetic polynucleotide
  modified_base (1)..(39): a, c, t, g, unknown or other
  modified_base (184)..(357): a, c, t, g, unknown or other
nnnnnnnnnnnnnnnnnnnnnnnnnnnnnnnnnnnnnnngaggaattggccatcaaagagcaagaggaattcaacatcggtccactgtcggtgctcacccattccgtgcgcaatcatgcccaagttctgatcaattgccgcaacaacaaaaagctccttgggcgcatcaaagcattcgatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1012 - DNA, 258 bp, Artificial Sequence
  Description of Artificial Sequence: Synthetic polynucleotide
  modified_base (1)..(9): a, c, t, g, unknown or other
  modified_base (92)..(92): a, c, t, g, unknown or other
  modified_base (94)..(95): a, c, t, g, unknown or other
  modified_base (98)..(98): a, c, t, g, unknown or other
  modified_base (111)..(111): a, c, t, g, unknown or other
  modified_base (147)..(147): a, c, t, g, unknown or other
  modified_base (202)..(258): a, c, t, g, unknown or other
nnnnnnnnnattcagccgctaaatcccaaaccatttctgaatggtctcgctggaaaacctatcatttgtaaactgaagtggggaatggaatntnnagnaattcttgtctcngtggatggatacatgaatcttcatttggcaaacacngaagaatacattgatggtaccaatacaggtgcactcggcgaagttctcatcaggnnnnnnnnnnnnnnnnnnnnnnnnnnnnnnnnnnnnnnnnnnnnnnnnnnnnnnnnn

SEQ ID NO: 1013 - DNA, 273 bp, Artificial Sequence
  Description of Artificial Sequence: Synthetic polynucleotide
  modified_base (1)..(153): a, c, t, g, unknown or other
  modified_base (262)..(273): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtgatcgatgaggcggaggaaatcaacgtcaaatcattgaatcgccataagcttggccgcattctgctcaagggcgacaacattaccctaatccaaaccgttcaannnnnnnnnnnn

SEQ ID NO: 1014 - DNA, 234 bp, Artificial Sequence
  Description of Artificial Sequence: Synthetic polynucleotide
  modified_base (1)..(72): a, c, t, g, unknown or other
  modified_base (217)..(234): a, c, t, g, unknown or other
nnnnnnnnnnnnnnnnnnnnnnnnnnnnnnnnnnnnnnnnnnnnnnnnnnnnnnnnnnnnnnnnnnnnnnnnaggaatatttcgggtgttctgcgcggcttcgacccattcatgaacattgttgttgaagattgcattgagcacctcaagagtggcgaatcacaatcaattgggatggtcgtcgttcgcggaaacagcattgtgataatggagccgnnnnnnnnnnnnnnnnnn

SEQ ID NO: 1015 - DNA, 666 bp, Artificial Sequence
  Description of Artificial Sequence: Synthetic polynucleotide
  modified_base (1)..(63): a, c, t, g, unknown or other
  modified_base (226)..(537): a, c, t, g, unknown or other
  modified_base (661)..(666): a, c, t, g, unknown or other
nnnnnnnnnnnnnnnnnnnnnnnnnnnnnnnnnnnnnnnnnnnnnnnnnnnnnnnnnnnnnnnacaagatgtaaacatgcccttccggatctcccctatgattataattcattggaaccagttatatccgcagagatcatgcaaattcatcatcagaagcatcatgcaacatatgtaaacaatttaaatcaagctgaagagaaaacacaagaagcattagggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtctggacgtatgggagcacgcttactacctgaaatatcaaaacaaacgtcctgattacatcggtgcattctggaacgtaatcaactgggatgaagtaaacaaacgttacgcagcagcgaaannnnnn

SEQ ID NO: 1016 - DNA, 1377 bp, Artificial Sequence; identical to SEQ ID NO: 438
  Description of Artificial Sequence: Synthetic polynucleotide
  modified_base (1)..(285): a, c, t, g, unknown or other
  modified_base (453)..(453): a, c, t, g, unknown or other
  modified_base (455)..(456): a, c, t, g, unknown or other
  modified_base (459)..(459): a, c, t, g, unknown or other
  modified_base (461)..(462): a, c, t, g, unknown or other
  modified_base (588)..(588): a, c, t, g, unknown or other
  modified_base (829)..(1377): a, c, t, g, unknown or other

SEQ ID NO: 1017 - DNA, 1194 bp, Artificial Sequence
  Description of Artificial Sequence: Synthetic polynucleotide
  modified_base (1)..(183): a, c, t, g, unknown or other
  modified_base (342)..(342): a, c, t, g, unknown or other
  modified_base (403)..(537): a, c, t, g, unknown or other
  modified_base (661)..(684): a, c, t, g, unknown or other
  modified_base (775)..(1014): a, c, t, g, unknown or other
  modified_base (1189)..(1194): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaaacaattcgccggttggagacgacggccagcaatttgtacaaggagaagaagattcgcggattttgtcatctctattccggacaagaagcatgtgcggttggaattgttgcggccaccgatgacaaggatgccgtcattaccgcttatagatgncatggttggacatatttgatgggtgccaccgtgaccgatgttttggccgaattgactggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaagaacatttgcctgacactatacggggatggggccgccaatcaaggtcaactgttcgaggcaaccaatatggccaaactgtggaatttgccatgcattttcatttgcgagaacaatgggnnnnnnnnnnnnnnnnnnnnnnnncgggcctcggcttccaccgactactacactcgaggcgactatgttcccggactttgggtcgatggcatggatttgctgaccgttagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgttggcaaggcatatgaaatggcacatattgacggggaattgccacccgacggtttgtatgcggacatttatgcaaacacaccgccccaatggatccggggattgacccatcaatcgagtgtgacgcagaaatacacaaacagtgaagaattgatgaaagattatggaaaannnnnn

SEQ ID NO: 1018 - DNA, 1332 bp, Artificial Sequence; identical to SEQ ID NO: 460
  Description of Artificial Sequence: Synthetic polynucleotide
  modified_base (1)..(54): a, c, t, g, unknown or other
  modified_base (111)..(111): a, c, t, g, unknown or other
  modified_base (288)..(288): a, c, t, g, unknown or other
  modified_base (316)..(438): a, c, t, g, unknown or other
  modified_base (652)..(652): a, c, t, g, unknown or other
  modified_base (681)..(681): a, c, t, g, unknown or other
  modified_base (687)..(687): a, c, t, g, unknown or other
  modified_base (690)..(690): a, c, t, g, unknown or other
  modified_base (705)..(705): a, c, t, g, unknown or other
  modified_base (726)..(726): a, c, t, g, unknown or other
  modified_base (729)..(729): a, c, t, g, unknown or other
  modified_base (732)..(732): a, c, t, g, unknown or other
  modified_base (744)..(744): a, c, t, g, unknown or other
  modified_base (777)..(778): a, c, t, g, unknown or other
  modified_base (780)..(780): a, c, t, g, unknown or other
  modified_base (784)..(784): a, c, t, g, unknown or other
  modified_base (786)..(787): a, c, t, g, unknown or other
  modified_base (789)..(790): a, c, t, g, unknown or other
  modified_base (949)..(951): a, c, t, g, unknown or other
  modified_base (1024)..(1140): a, c, t, g, unknown or other
  modified_base (1234)..(1332): a, c, t, g, unknown or other

SEQ ID NO: 1019 - DNA, 1131 bp, Artificial Sequence
  Description of Artificial Sequence: Synthetic polynucleotide
  modified_base (1)..(870): a, c, t, g, unknown or other
  modified_base (985)..(1131): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgtatctgtgatacaccaacaatttgtcggatttgtggccttttattactgacagctccacagttagccagggcacatcagcatcttgaaccgctcgcaaactttactgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1020 - DNA, 558 bp, Artificial Sequence
  Description of Artificial Sequence: Synthetic polynucleotide
  modified_base (1)..(87): a, c, t, g, unknown or other
  modified_base (166)..(174): a, c, t, g, unknown or other
  modified_base (213)..(213): a, c, t, g, unknown or other
  modified_base (226)..(228): a, c, t, g, unknown or other
  modified_base (280)..(558): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnctcagggatgtgctgccattgttcgctaaacccgcacttctccaatcattgtgcaaatttattgcaaatcgatacaaannnnnnnnnggcaaagtggatgtagtggctggtttggaagcgagagcntttctatttggannntcaatttgcatacgaatgggtttaccatttgttccaattaggaagaaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1021 - DNA, 1455 bp, Artificial Sequence
  Description of Artificial Sequence: Synthetic polynucleotide
  modified_base (10)..(13): a, c, t, g, unknown or other
  modified_base (15)..(15): a, c, t, g, unknown or other
  modified_base (20)..(21): a, c, t, g, unknown or other
  modified_base (36)..(36): a, c, t, g, unknown or other
  modified_base (39)..(39): a, c, t, g, unknown or other
  modified_base (45)..(46): a, c, t, g, unknown or other
  modified_base (51)..(51): a, c, t, g, unknown or other
  modified_base (54)..(56): a, c, t, g, unknown or other
  modified_base (58)..(58): a, c, t, g, unknown or other
  modified_base (60)..(60): a, c, t, g, unknown or other
  modified_base (66)..(67): a, c, t, g, unknown or other
  modified_base (69)..(73): a, c, t, g, unknown or other
  modified_base (75)..(75): a, c, t, g, unknown or other
  modified_base (78)..(78): a, c, t, g, unknown or other
  modified_base (81)..(83): a, c, t, g, unknown or other
  modified_base (87)..(87): a, c, t, g, unknown or other
  modified_base (89)..(90): a, c, t, g, unknown or other
  modified_base (92)..(92): a, c, t, g, unknown or other
  modified_base (96)..(96): a, c, t, g, unknown or other
  modified_base (100)..(100): a, c, t, g, unknown or other
  modified_base (102)..(103): a, c, t, g, unknown or other
  modified_base (106)..(107): a, c, t, g, unknown or other
  modified_base (109)..(109): a, c, t, g, unknown or other
  modified_base (111)..(111): a, c, t, g, unknown or other
  modified_base (114)..(120): a, c, t, g, unknown or other
  modified_base (124)..(124): a, c, t, g, unknown or other
  modified_base (127)..(127): a, c, t, g, unknown or other
  modified_base (135)..(135): a, c, t, g, unknown or other
  modified_base (142)..(142): a, c, t, g, unknown or other
  modified_base (144)..(144): a, c, t, g, unknown or other
  modified_base (147)..(147): a, c, t, g, unknown or other
  modified_base (149)..(150): a, c, t, g, unknown or other
  modified_base (153)..(153): a, c, t, g, unknown or other
  modified_base (259)..(273): a, c, t, g, unknown or other
  modified_base (427)..(429): a, c, t, g, unknown or other
  modified_base (432)..(432): a, c, t, g, unknown or other
  modified_base (435)..(438): a, c, t, g, unknown or other
  modified_base (443)..(444): a, c, t, g, unknown or other
  modified_base (447)..(447): a, c, t, g, unknown or other
  modified_base (451)..(451): a, c, t, g, unknown or other
  modified_base (453)..(457): a, c, t, g, unknown or other
  modified_base (459)..(460): a, c, t, g, unknown or other
  modified_base (465)..(468): a, c, t, g, unknown or other
  modified_base (475)..(476): a, c, t, g, unknown or other
  modified_base (478)..(481): a, c, t, g, unknown or other
  modified_base (484)..(484): a, c, t, g, unknown or other
  modified_base (486)..(488): a, c, t, g, unknown or other
  modified_base (491)..(493): a, c, t, g, unknown or other
  modified_base (495)..(495): a, c, t, g, unknown or other
  modified_base (498)..(499): a, c, t, g, unknown or other
  modified_base (501)..(501): a, c, t, g, unknown or other
  modified_base (503)..(504): a, c, t, g, unknown or other
  modified_base (515)..(516): a, c, t, g, unknown or other
  modified_base (518)..(519): a, c, t, g, unknown or other
  modified_base (523)..(523): a, c, t, g, unknown or other
  modified_base (532)..(534): a, c, t, g, unknown or other
  modified_base (540)..(540): a, c, t, g, unknown or other
  modified_base (544)..(544): a, c, t, g, unknown or other
  modified_base (555)..(555): a, c, t, g, unknown or other
  modified_base (567)..(567): a, c, t, g, unknown or other
  modified_base (570)..(570): a, c, t, g, unknown or other
  modified_base (573)..(573): a, c, t, g, unknown or other
  modified_base (576)..(579): a, c, t, g, unknown or other
  modified_base (583)..(585): a, c, t, g, unknown or other
  modified_base (587)..(588): a, c, t, g, unknown or other
  modified_base (591)..(592): a, c, t, g, unknown or other
  modified_base (597)..(597): a, c, t, g, unknown or other
  modified_base (599)..(600): a, c, t, g, unknown or other
  modified_base (603)..(604): a, c, t, g, unknown or other
  modified_base (606)..(607): a, c, t, g, unknown or other
  modified_base (609)..(610): a, c, t, g, unknown or other
  modified_base (613)..(616): a, c, t, g, unknown or other
  modified_base (618)..(619): a, c, t, g, unknown or other
  modified_base (621)..(621): a, c, t, g, unknown or other
  modified_base (778)..(780): a, c, t, g, unknown or other
  modified_base (783)..(783): a, c, t, g, unknown or other
  modified_base (843)..(843): a, c, t, g, unknown or other
  modified_base (979)..(1059): a, c, t, g, unknown or other
  modified_base (1216)..(1216): a, c, t, g, unknown or other
  modified_base (1227)..(1227): a, c, t, g, unknown or other
  modified_base (1231)..(1231): a, c, t, g, unknown or other
  modified_base (1233)..(1234): a, c, t, g, unknown or other
  modified_base (1236)..(1236): a, c, t, g, unknown or other
  modified_base (1238)..(1239): a, c, t, g, unknown or other
  modified_base (1242)..(1242): a, c, t, g, unknown or other
  modified_base (1245)..(1246): a, c, t, g, unknown or other
  modified_base (1249)..(1251): a, c, t, g, unknown or other
  modified_base (1254)..(1254): a, c, t, g, unknown or other
  modified_base (1257)..(1257): a, c, t, g, unknown or other
  modified_base (1261)..(1261): a, c, t, g, unknown or other
  modified_base (1263)..(1263): a, c, t, g, unknown or other
  modified_base (1268)..(1269): a, c, t, g, unknown or other
  modified_base (1273)..(1274): a, c, t, g, unknown or other
  modified_base (1276)..(1278): a, c, t, g, unknown or other
  modified_base (1281)..(1282): a, c, t, g, unknown or other
  modified_base (1284)..(1285): a, c, t, g, unknown or other
  modified_base (1287)..(1287): a, c, t, g, unknown or other
  modified_base (1289)..(1289): a, c, t, g, unknown or other
  modified_base (1292)..(1293): a, c, t, g, unknown or other
  modified_base (1297)..(1297): a, c, t, g, unknown or other
  modified_base (1302)..(1302): a, c, t, g, unknown or other
  modified_base (1305)..(1305): a, c, t, g, unknown or other
  modified_base (1308)..(1308): a, c, t, g, unknown or other
  modified_base (1311)..(1313): a, c, t, g, unknown or other
  modified_base (1323)..(1323): a, c, t, g, unknown or other
  modified_base (1326)..(1326): a, c, t, g, unknown or other
  modified_base (1330)..(1330): a, c, t, g, unknown or other
  modified_base (1335)..(1335): a, c, t, g, unknown or other
  modified_base (1344)..(1344): a, c, t, g, unknown or other
  modified_base (1350)..(1350): a, c, t, g, unknown or other
  modified_base (1356)..(1356): a, c, t, g, unknown or other
  modified_base (1359)..(1359): a, c, t, g, unknown or other
  modified_base (1362)..(1365): a, c, t, g, unknown or other
  modified_base (1367)..(1367): a, c, t, g, unknown or other
  modified_base (1369)..(1369): a, c, t, g, unknown or other
  modified_base (1372)..(1375): a, c, t, g, unknown or other
  modified_base (1377)..(1377): a, c, t, g, unknown or other
  modified_base (1379)..(1379): a, c, t, g, unknown or other
  modified_base (1383)..(1386): a, c, t, g, unknown or other
  modified_base (1390)..(1391): a, c, t, g, unknown or other
  modified_base (1393)..(1398): a, c, t, g, unknown or other
  modified_base (1453)..(1455): a, c, t, g, unknown or other
atgagtaaannnnanattgnngtcattggacttgcngtnatgggnnaaaanctnnntntnaacatnnannnnnanggnttnnnggtntnngnattnaacngnncanngnanaannnnnnngatnttntggaaaangaagcananggnannaanctgatcggaacgttttccattgaagagttcgtagcttctttggaatcaccacgcaaaatcttgattatggtacaagcgggtaaagcaacggatgctactattgagnnnnnnnnnnnnnnnctgtccaaaggtgatatcatcatcgaagcagggaactctcactacaaagaatccatccgtcgttacgagcagctgaaaccacaaggcattcattacatggatgcaggaacttcaggcggtatggaaggtgcgcgtaacggtgcatgttacatgnnnggnggnnnnccggnngcntggncnnnnntnnagccnnnnttccagnnannnnctncnnnagnnnanggnnancnntgttgcgaatnngnnggtnaagcaggtnnnggtcanttcntcaaaatggtncacaacggaatngantanggnnnnatgnnntnnatnngtgangnnttnnanntnntgnnnnanngnttgggcctgaattatgaccaaatggctcaggtattcgaagactggaacaaaggcgaattggactcattcctgatcgaaatcacagcaaacattttgcgttatcgagacgagaaaggcgagccccttgtgcccaaaatacttgactcagcccaacagnnnggnactggcaaatggacgggcattgccgccttggaatatggtgtcccagttactttaattctngaagctgttttcgcccgttgcctttccgccctgaaagcccaacgcgtttctgcatcgaaagtattgcctggaccttcaaaaaaagtggatcaaattgtcaaggataggaatgtattcttagaccatattggcaagnnnnnnnnnnnnnnnnnnnnnnnnnnnnnnnnnnnnnnnnnnnnnnnnnnnnnnnnnnnnnnnnnnnnnnnnnnnnnnnnnctgaaatacggcaacatcgcgatgatcttccgtgggggttgcatcatccgttcacagttcctgcaaaacatcaaggaagcatatgacaaagatgcagccctgaaaaacctgctccttgatccatacttccaaaacatcgtggaatcctaccaggatncatggcgtgangtgntnncngnngcngtnnaannnggnatnccgntnccagnnttcnncnnngcnntnncntnctnngacngctancgnacngannntttgccggcnaanttgntgcangcacaacgngactanttcggngcncannnntncnaannnntngncaannnngganncnnnnnncacacaaattggactggcaaaggcggtcgtgtcacatccaatgcctattccgctnnn

SEQ ID NO: 1022 - DNA, 330 bp, Artificial Sequence
  Description of Artificial Sequence: Synthetic polynucleotide
  modified_base (1)..(33): a, c, t, g, unknown or other
  modified_base (159)..(161): a, c, t, g, unknown or other
  modified_base (165)..(166): a, c, t, g, unknown or other
  modified_base (169)..(170): a, c, t, g, unknown or other
  modified_base (172)..(172): a, c, t, g, unknown or other
  modified_base (174)..(175): a, c, t, g, unknown or other
  modified_base (177)..(181): a, c, t, g, unknown or other
  modified_base (228)..(228): a, c, t, g, unknown or other
  modified_base (234)..(234): a, c, t, g, unknown or other
  modified_base (241)..(241): a, c, t, g, unknown or other
  modified_base (246)..(246): a, c, t, g, unknown or other
  modified_base (328)..(330): a, c, t, g, unknown or other
nnnnnnnnnnnnnnnnnnnnnnnnnnnnnnnnntcttttgagcaactcgaagaggaggaaggaaaacgccaaggcttctgccacattcgcattcaacaaagaactgggcggaagacgatcacaaccgtgcaaggcatagacaaagcttatgacctgaannnaatnnttnntnanntnnnnnaggaatacaattgtaacggaacaatcattgagcatccagaatatggngaagtnatccaantgacnggcgaccaacggcaacatattaaggattttctatgcaaagttggaattgtgaaagaagacaattgcaagattcatggtttcnnn

SEQ ID NO: 1023 - DNA, 1206 bp, Artificial Sequence
  Description of Artificial Sequence: Synthetic polynucleotide
  modified_base (1)..(663): a, c, t, g, unknown or other
  modified_base (901)..(1020): a, c, t, g, unknown or other
  modified_base (1132)..(1206): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttatgaaggtggattttggaggagaaccgaattgtgaggccacggcgggtatacattttgttcgctggctgcacttaaaatattacaaaaaattaatttaataaatttggatgatgttttacgatggttggtgaaccggcaaatgagatatgaaggtggttttcagggtagaacaaataaattggtggatgtttgttattcctattggattgctgcctgctttccagcactggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccatccgatatgtaccacacatgttatgcattatccggactttcaattgcccaatcttttgcaaaaacaaataaagaagaaattctggccaaggaaacgaatcaactgnnnnnnnnnnnnnnnnnnnnnnnnnnnnnnnnnnnnnnnnnnnnnnnnnnnnnnnnnnnnnnnnnnnnnnnnnnn

SEQ ID NO: 1024 - DNA, 1485 bp, Artificial Sequence; identical to SEQ ID NO: 499
  Description of Artificial Sequence: Synthetic polynucleotide
  modified_base (1)..(387): a, c, t, g, unknown or other
  modified_base (823)..(825): a, c, t, g, unknown or other
  modified_base (883)..(1104): a, c, t, g, unknown or other
  modified_base (1161)..(1161): a, c, t, g, unknown or other
  modified_base (1194)..(1194): a, c, t, g, unknown or other
  modified_base (1227)..(1227): a, c, t, g, unknown or other
  modified_base (1465)..(1485): a, c, t, g, unknown or other

SEQ ID NO: 1025 - DNA, 2358 bp, Artificial Sequence
  Description of Artificial Sequence: Synthetic polynucleotide
  modified_base (1)..(798): a, c, t, g, unknown or other
  modified_base (949)..(1242): a, c, t, g, unknown or other
  modified_base (1431)..(1431): a, c, t, g, unknown or other
  modified_base (1561)..(1563): a, c, t, g, unknown or other
  modified_base (1632)..(1632): a, c, t, g, unknown or other
  modified_base (1750)..(1755): a, c, t, g, unknown or other
  modified_base (1936)..(1938): a, c, t, g, unknown or other
  modified_base (2263)..(2358): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcatattctcttttgctctctggctatttacgtggaatgccattaaatgttaacaatttggtgcatatacccggttatggagattttcaattaaagcaaattgatctaaaatctgatccattgaaagtgaaaaaggtaaattgaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggatatggaatctgaaaaaatgtctgctttgggtgagaataacattgacgaaacattggatgattcccaactacaacgtttcaaacaacaaagagaaaatcggcaatggccagatgaaatggaaactccacaagggatgaatgcccgtgaacgtttccaacgttatagaggcttgaagagttttagnacaagtccttgggatccaaaagagaatttgcctcttgaatatgcaagaatttataaaattgttgatttcaaacgaacacgtaaactagcattggctgaattaaagaatgcatttggacaaactgacagcnnngatgaatatgtatttcctggtgcttttgttacattgcacattaaaaatattcctgagcaattatacaanaatattcatgcaaaaaacactcttattgtttatgggctacttcgtcatgagcatcgaatgtcaattctgaatttggtccttcaaagacatccatcttgtacaattccgatacggaacnnnnnnaaagatccgcttattttccaagttggatgtcggcaatttacagcaaatccaatattctcacaacacacaaatggcgataaatttaagatggaacgattcatgccagattcaggtgcattctgcgcaacaattcttgcgccaattacattcccaccaaccaatgtaattgttttttccaaannncaaatggcaaaacaacaattattggcacatggaatggttttggatgtaaatccggatagaattattttgaaaagagttgtcctctctggtcatccattcaaagtgaataaacggactgcggttgttcgatatatgttcttcaatcgagaggatattgaatggttcaagccgattgaattatacactcatggtggccggcatggaagaataaaacaagcgctgggcactcacggacatatgaaatgtaattttgaccaaccattgaatgttcaggattcggttatgatgaatttatacaaaagagtttacccgaaatggacatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1026 - DNA, 897 bp, Artificial Sequence
  Description of Artificial Sequence: Synthetic polynucleotide
  modified_base (1)..(99): a, c, t, g, unknown or other
  modified_base (162)..(168): a, c, t, g, unknown or other
  modified_base (171)..(171): a, c, t, g, unknown or other
  modified_base (174)..(175): a, c, t, g, unknown or other
  modified_base (177)..(180): a, c, t, g, unknown or other
  modified_base (183)..(183): a, c, t, g, unknown or other
  modified_base (187)..(187): a, c, t, g, unknown or other
  modified_base (189)..(189): a, c, t, g, unknown or other
  modified_base (196)..(197): a, c, t, g, unknown or other
  modified_base (210)..(211): a, c, t, g, unknown or other
  modified_base (214)..(216): a, c, t, g, unknown or other
  modified_base (219)..(222): a, c, t, g, unknown or other
  modified_base (230)..(232): a, c, t, g, unknown or other
  modified_base (235)..(235): a, c, t, g, unknown or other
  modified_base (237)..(241): a, c, t, g, unknown or other
  modified_base (244)..(246): a, c, t, g, unknown or other
  modified_base (249)..(253): a, c, t, g, unknown or other
  modified_base (255)..(257): a, c, t, g, unknown or other
  modified_base (260)..(262): a, c, t, g, unknown or other
  modified_base (265)..(266): a, c, t, g, unknown or other
  modified_base (268)..(269): a, c, t, g, unknown or other
  modified_base (276)..(277): a, c, t, g, unknown or other
  modified_base (279)..(279): a, c, t, g, unknown or other
  modified_base (286)..(288): a, c, t, g, unknown or other
  modified_base (290)..(290): a, c, t, g, unknown or other
  modified_base (298)..(298): a, c, t, g, unknown or other
  modified_base (302)..(304): a, c, t, g, unknown or other
  modified_base (309)..(309): a, c, t, g, unknown or other
  modified_base (311)..(312): a, c, t, g, unknown or other
  modified_base (430)..(561): a, c, t, g, unknown or other
  modified_base (778)..(780): a, c, t, g, unknown or other
  modified_base (880)..(897): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgctgagaaatttcaaagatgatctttcggtcgaatggatatgcaaatgtttttccgannnnnnngcnctnntnnnncangaantngcctatnntcttggacaaatnnaannnccnnnngcaattgnnnaantnnnnnaannnctnnnnnannnaannnaanntnnaatggtnngncatgaannngncgaagcantggnnncaatngnngatcatgaccaaaaaaaaatattatccaaatttatcaatgatccaatcaaagaagttgcggaaacttgtcaattagccataaaaatgattgaatggaaattggaaaacaacaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattaattccaaaatgaatttaatttgtatttttttaggcttattttgtgaggacagtgcactatttcgtcacgaagttgcctatgttcttggacaaattcaatcgcccgttgcaattgatgaattaaagcaacgactttgtaagccaatggaaaatggaatggtccggcatgaatgcgccgaagcattgggttcaattgcaacggaagaatgtnnntaaatattgaggcaatttcttaagatgaggaggcgcgttgtgagggaaagttgcgaagttgcattggaaattgccaaacaaaatggagccaatgaattannnnnnnnnnnnnnnnnn

SEQ ID NO: 1027 - DNA, 744 bp, Artificial Sequence
  Description of Artificial Sequence: Synthetic polynucleotide
  modified_base (1)..(210): a, c, t, g, unknown or other
  modified_base (267)..(270): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (288)..(288): a, c, t, g, unknown or other
  modified_base (291)..(291): a, c, t, g, unknown or other
  modified_base (297)..(300): a, c, t, g, unknown or other
  modified_base (305)..(305): a, c, t, g, unknown or other
  modified_base (311)..(312): a, c, t, g, unknown or other
  modified_base (316)..(317): a, c, t, g, unknown or other
  modified_base (319)..(322): a, c, t, g, unknown or other
  modified_base (324)..(326): a, c, t, g, unknown or other
  modified_base (328)..(330): a, c, t, g, unknown or other
  modified_base (334)..(342): a, c, t, g, unknown or other
  modified_base (346)..(346): a, c, t, g, unknown or other
  modified_base (348)..(350): a, c, t, g, unknown or other
  modified_base (352)..(353): a, c, t, g, unknown or other
  modified_base (361)..(362): a, c, t, g, unknown or other
  modified_base (364)..(366): a, c, t, g, unknown or other
  modified_base (369)..(369): a, c, t, g, unknown or other
  modified_base (371)..(371): a, c, t, g, unknown or other
  modified_base (376)..(376): a, c, t, g, unknown or other
  modified_base (381)..(381): a, c, t, g, unknown or other
  modified_base (386)..(386): a, c, t, g, unknown or other
  modified_base (388)..(388): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (411)..(411): a, c, t, g, unknown or other
  modified_base (414)..(414): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (456)..(456): a, c, t, g, unknown or other
  modified_base (484)..(485): a, c, t, g, unknown or other
  modified_base (496)..(496): a, c, t, g, unknown or other
  modified_base (498)..(498): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (520)..(520): a, c, t, g, unknown or other
  modified_base (523)..(523): a, c, t, g, unknown or other
  modified_base (525)..(525): a, c, t, g, unknown or other
  modified_base (527)..(529): a, c, t, g, unknown or other
  modified_base (531)..(535): a, c, t, g, unknown or other
  modified_base (537)..(537): a, c, t, g, unknown or other
  modified_base (541)..(541): a, c, t, g, unknown or other
  modified_base (543)..(543): a, c, t, g, unknown or other
  modified_base (550)..(551): a, c, t, g, unknown or other
  modified_base (553)..(554): a, c, t, g, unknown or other
  modified_base (557)..(558): a, c, t, g, unknown or other
  modified_base (561)..(561): a, c, t, g, unknown or other
  modified_base (564)..(566): a, c, t, g, unknown or other
  modified_base (570)..(571): a, c, t, g, unknown or other
  modified_base (573)..(574): a, c, t, g, unknown or other
  modified_base (576)..(577): a, c, t, g, unknown or other
  modified_base (579)..(587): a, c, t, g, unknown or other
  modified_base (589)..(594): a, c, t, g, unknown or other
  modified_base (597)..(598): a, c, t, g, unknown or other
  modified_base (600)..(601): a, c, t, g, unknown or other
  modified_base (603)..(603): a, c, t, g, unknown or other
  modified_base (613)..(613): a, c, t, g, unknown or other
  modified_base (615)..(616): a, c, t, g, unknown or other
  modified_base (620)..(620): a, c, t, g, unknown or other
  modified_base (622)..(623): a, c, t, g, unknown or other
  modified_base (626)..(626): a, c, t, g, unknown or other
  modified_base (636)..(636): a, c, t, g, unknown or other
  modified_base (657)..(657): a, c, t, g, unknown or other
  modified_base (668)..(668): a, c, t, g, unknown or other
  modified_base (680)..(680): a, c, t, g, unknown or other
  modified_base (742)..(744): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagccttcactggggaaataagtcctgaaatgatcaaagatgtcggagggaaatannnnatnatnggtcantcggancgncgtcannnntttgnggaaanngatnngnnnntnnntnnnaagnnnnnnnnngcantnnntnntggattgnntnnnatntnctgcnttggngaaangntngaagancgngangcaaaccanacnaaagangtnaatttncgccaattggaagcattaattgccaanaacctggattggtcaaaagttgttatannttatgagccantntgggcnattggnacnggtaaanccncnannncnnnnnangcgnangaagttnntnnttnnatncgnnnattnntnnannannnnnnnnncnnnnnngtnncnnantcaactagantnntttntnnagnatcagttacngctgacaattgcgttgaattngccaaacagcngaatgtggatgnttttcttgttggcggtgcatcattgaaaccggacttcatcaagattataaatgccaactcgnnn

SEQ ID NO: 1028 - DNA, 2178 bp, Artificial Sequence
  Description of Artificial Sequence: Synthetic polynucleotide
  modified_base (1)..(327): a, c, t, g, unknown or other
  modified_base (483)..(483): a, c, t, g, unknown or other
  modified_base (574)..(1218): a, c, t, g, unknown or other
  modified_base (1504)..(1518): a, c, t, g, unknown or other
  modified_base (1662)..(1665): a, c, t, g, unknown or other
  modified_base (1671)..(1671): a, c, t, g, unknown or other
  modified_base (1676)..(1676): a, c, t, g, unknown or other
  modified_base (1680)..(1681): a, c, t, g, unknown or other
  modified_base (1686)..(1687): a, c, t, g, unknown or other
  modified_base (1689)..(1689): a, c, t, g, unknown or other
  modified_base (1693)..(1693): a, c, t, g, unknown or other
  modified_base (1695)..(1695): a, c, t, g, unknown or other
  modified_base (1698)..(1699): a, c, t, g, unknown or other
  modified_base (1701)..(1701): a, c, t, g, unknown or other
  modified_base (1704)..(1705): a, c, t, g, unknown or other
  modified_base (1707)..(1709): a, c, t, g, unknown or other
  modified_base (1713)..(1713): a, c, t, g, unknown or other
  modified_base (1716)..(1717): a, c, t, g, unknown or other
  modified_base (1719)..(1721): a, c, t, g, unknown or other
  modified_base (1726)..(1727): a, c, t, g, unknown or other
  modified_base (1730)..(1730): a, c, t, g, unknown or other
  modified_base (1734)..(1744): a, c, t, g, unknown or other
  modified_base (1746)..(1746): a, c, t, g, unknown or other
  modified_base (1749)..(1749): a, c, t, g, unknown or other
  modified_base (1752)..(1752): a, c, t, g, unknown or other
  modified_base (1755)..(1755): a, c, t, g, unknown or other
  modified_base (1758)..(1759): a, c, t, g, unknown or other
  modified_base (1852)..(2178): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggactcgctgataaagttgtaattgccaaagtcaatgatgaactatgggatttggatagaccattggaggcggatgccaccctaaaattgttgacattcgacgatgatgaaggcaaacaagttttttggcatagctcagcgcacattcttggngaagctgccgaacgctatcgtggagttcatctttgctatggtccaccaattcaagaaggattttattatgatatgttcattgaagggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgtccgatgaactgtcctcaccacatgatggtgtacaaatccaatatgcacagctaccgtgatcttccgatccgtattgccgaactgggtatgatgcatcgctatgaaatgtcaggtgcgttgacaggtctgcaccgtgtacgtgcgatgacactgaatgactctcacatctttgcacgtccggatcagatcaaagaagagtttgctcgtgttatcgaattgatccaaacggtatataaagactttggcattcacgaatatcgtttccgtctatcttaccgtnnnnnnnnnnnnnnnggctcggaagaattgtgggatcaggcggaacaggcgttacgcaatgtgttagacgcccgcggtgtggaatatcgcattaacgaaggcgacggcgccttttacgggccgaagatcgactttcacatacttgatgcgctgaagcgnnnntggcantgcgnaacnntccanntngatntncanntnccnnannnattnganntnnnttatnntgntgannnnnnnnnnngncancgnccngtnntgattcatcgtgcaattttcggctcattggaacgtttcattgcaattttgacggaaaattttgccggaaaatggccattctggctttcacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1029 - DNA, 921 bp, Artificial Sequence
  Description of Artificial Sequence: Synthetic polynucleotide
  modified_base (1)..(261): a, c, t, g, unknown or other
  modified_base (391)..(393): a, c, t, g, unknown or other
  modified_base (507)..(507): a, c, t, g, unknown or other
  modified_base (559)..(597): a, c, t, g, unknown or other
  modified_base (711)..(711): a, c, t, g, unknown or other
  modified_base (789)..(789): a, c, t, g, unknown or other
  modified_base (919)..(921): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttggccaatgcccaacgccgggtgatgaacagcactgatcgccaaatgacgcaggcgttgatgttaattcgggaaatgagcgagaaaatcagtttggcgcggacaatccaagaaagggccgcaaagnnnttcaaagaagttttggaatcgaaggcattgaggggcaaaagcaacgaagcacaggcagcggcatgtttgtacattgcttgtcgggaagagggcgtcccacgaacattcaaaaanatttgcgcagtttcaaaagtgtcaaagaaggaaattggcaaatgttttcggnnnnnnnnnnnnnnnnnnnnnnnnnnnnnnnnnnnnnnnacaaataattttctgcagtctcgtttctgtggcaatttgaatttgccgtatccggtccaagttgctgccactcgaattgcccaggaggcactcaaaatggatttggtggccggncgtagtccaatttccattgccgcagctgccattttccttgcctcgcaggccagtgccgaaaaacgaacggccaaaaanattggtgaaattgccggcgccgccgaggacacaattcgtctgacctatcgtcttttgttgccaaaagccaaggaattgtttccgcccgaattccgtttccacactccaatcgaccaattgccacgttcannn

SEQ ID NO: 1030 - DNA, 579 bp, Artificial Sequence; identical to SEQ ID NO: 585
  Description of Artificial Sequence: Synthetic polynucleotide
  modified_base (166)..(279): a, c, t, g, unknown or other
  modified_base (442)..(579): a, c, t, g, unknown or other

SEQ ID NO: 1031 - DNA, 501 bp, Artificial Sequence; identical to SEQ ID NO: 582
  Description of Artificial Sequence: Synthetic polynucleotide
  modified_base (114)..(114): a, c, t, g, unknown or other
  modified_base (309)..(309): a, c, t, g, unknown or other
  modified_base (412)..(501): a, c, t, g, unknown or other

SEQ ID NO: 1032 - DNA, 222 bp, Artificial Sequence
  Description of Artificial Sequence: Synthetic polynucleotide
  modified_base (1)..(144): a, c, t, g, unknown or other
  modified_base (220)..(222): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatctacaaagatcacattactctgctggattatgagataaatgatggattcaactttgaactatattatcaannn

SEQ ID NO: 1033 - DNA, 1029 bp, Artificial Sequence
  Description of Artificial Sequence: Synthetic polynucleotide
  modified_base (1)..(150): a, c, t, g, unknown or other
  modified_base (310)..(351): a, c, t, g, unknown or other
  modified_base (366)..(366): a, c, t, g, unknown or other
  modified_base (420)..(420): a, c, t, g, unknown or other
  modified_base (444)..(1029): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcttccacaatcttgtctggacacgctgattcgccgtaacattaaatatccaatgctcttcaaattaaccaatctccaatttcaaaagtcaacccatgccggtgtgctcgaatttttggcggaagaaggcagatgttatttgccaaattgggtaattnnnnnnnnnnnnnnnnnnnnnnnnnnnnnnnnnnnnnnnnnntctagatcattgccngcggctacatatgcaaaattcaagccaatgtccactgacttctacaatgttacnaatccaaaggctatgctcgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1034 - DNA, 1269 bp, Artificial Sequence
  Description of Artificial Sequence: Synthetic polynucleotide
  modified_base (1)..(360): a, c, t, g, unknown or other
  modified_base (670)..(873): a, c, t, g, unknown or other
  modified_base (964)..(1269): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttatccacaaacaacggaaccgcgcattctgcaagaatatatcacccaagaaacacatcaattggaaattgcacctcggcccccaatggccgtgaccaatgccgtctcatggcgttcggaaggcataaaatatcgaaaaaatgaagtatttttggatgtgattgaatcggtcaatttgttggccaatgcaaatggaacagttttgcgcagcgaaattgtcggctcaattcgaatgcgagtaatcctttcgggaatgcccgaacttcgacttgggctcaatgataaagtactctttcaaactgttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttaaaaaaggcaaaatcccaattcaaacgtcgttccacggcgaataacgttgaaataatcattccggcaccgcgtgatgcggacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1035 - DNA, 1470 bp, Artificial Sequence
  Description of Artificial Sequence: Synthetic polynucleotide
  modified_base (364)..(927): a, c, t, g, unknown or other
  modified_base (1039)..(1470): a, c, t, g, unknown or other
atgcctaaaattaatgtaaagtgcggttctaaaacgctcaatgttgatgtggatttaaatgactctccgatgcttctcaaggcacaactttttggacttactgaaattcctccagaccgtcagaaactgttaatcaaaggcaaaacaattggcgacgaatcatgggagggaattacgatcaaggacgggtcaacaattatgcttgtcggtggaacggcctcagtgaatgtgcattcaaacaatgagaacaaggatagcggttcaccaacaaaaccagtcaaaagcaaagaagttttgctgccagtcggactcaaaaatttgggaaatacttgctacatgaatgccacccttcaatgctttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgccaaaatccttaaggatgtgaaatttccaattatcctcgacatttttgacatgtgcacaccggaattacaggaaaaattgaagccagctcgtcaggccctcaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1036 - DNA, 774 bp, Artificial Sequence
  Description of Artificial Sequence: Synthetic polynucleotide
  modified_base (48)..(48): a, c, t, g, unknown or other
  modified_base (139)..(441): a, c, t, g, unknown or other
  modified_base (568)..(774): a, c, t, g, unknown or other
atgtctggcggaggaaaagatagaattgcggttttccgtcccgaaggngctcaaactgttatgaagactcggctgaaaggagcacagaaaggccatagtttgctgaaaaagaaggccgatgccttgaacttgcgtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaattggccaccctccaaacatgcttcatcacactggacgaagcaatcaaaatcacaaatcgccgggtgaatgccatcgaacatgtcatcatacccaaaattgagaacacgctcacttatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1037 - DNA, 681 bp, Artificial Sequence; identical to SEQ ID NO: 508
  Description of Artificial Sequence: Synthetic polynucleotide
  modified_base (1)..(213): a, c, t, g, unknown or other
  modified_base (367)..(480): a, c, t, g, unknown or other
  modified_base (679)..(681): a, c, t, g, unknown or other

SEQ ID NO: 1038 - DNA, 1644 bp, Artificial Sequence
  Description of Artificial Sequence: Synthetic polynucleotide
  modified_base (1)..(93): a, c, t, g, unknown or other
  modified_base (316)..(645): a, c, t, g, unknown or other
  modified_base (739)..(756): a, c, t, g, unknown or other
  modified_base (951)..(951): a, c, t, g, unknown or other
  modified_base (1119)..(1119): a, c, t, g, unknown or other
  modified_base (1330)..(1446): a, c, t, g, unknown or other
  modified_base (1579)..(1644): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaagtattgtttcttgctcaaatgcccagagtgaaatgatgcagaaagaagtttatttgtttgaacgtttggattccggaaccgttcgtgaaccaattaaattcctaaaatgcattacattcgtccgaccaacaccagagaatatccaacttttatcggaggaattgcgatatccaaaatatgcacagtattatatttgtaagtcaatgggaatatcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcaataatttaaggatccggtctcacctttattgaatcaatggacctacgaggcgatggtgcacgaattgattggattaaacaataatcgannnnnnnnnnnnnnnnnnaatttggtgttgaatgcccaacatgatgaattctatgcaaaaaatatgtattcaaattttggggatattggacaaaacattaaatcgctgatgaatgattaccaaaggaaggcaaaaactcaccaacaattggaatcaataaatgatatgaaaaagtttgtggaacaatatccgcaattcaagaaaatgacaggnaccgtttcaaaacatgttcaattggtcggtgaattgagcaaattggttacggaaggaaatcttttggaaatttctgaattggaacaaaatattgttgcgaatggtgaccatcaagcttgttttgaatcatgagaaggctactccaaaatacaaaaacaacaaatagtnaatgcaattcgtttggcaatgctctatgcgctgagattcgaaaatagcacaaataattcattgaattcaattttggatttattacggcaacgcagcaaatcggcacattcaactcatcaaaacattactggattatgccgggcatcgacgacgcaaaatgatgtttttgggaatagatccgcaatggaaatgaccaaaaatttattaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttttgacaatgtaataatttttattattggcggtgcaacattcgaggaaagtgccacagtggccagcataaatgcccgaagatcgaatgcattgggaggaggccaaattggctcctatggatcgtcattgnnnnnnnnnnnnnnnnnnnnnnnnnnnnnnnnnnnnnnnnnnnnnnnnnnnnnnnnnnnnnnnnnn

SEQ ID NO: 1039 - DNA, 1368 bp, Artificial Sequence
  Description of Artificial Sequence: Synthetic polynucleotide
  modified_base (1)..(129): a, c, t, g, unknown or other
  modified_base (223)..(354): a, c, t, g, unknown or other
  modified_base (514)..(918): a, c, t, g, unknown or other
  modified_base (1321)..(1368): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcctttttatcggcaagtaattgtgatgtctttttattgtggacattgtggaaatcgaaatagcaatttacaatcgggtgaacaagcacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctaactacaattgagggtgttctccaatcagtaaaaacagatttgcaagcattacaaccacaaaggagagtagttgatccggaaacagccgaaaaattggaccgatttatcgcaaaaattgacaatctactttcacttgaagtcctatggacattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgatttggctcgagatttgttaaaatcggacacttgtacaatcgaaatacccgaaattgacattgaatttgggcctggaatgttttctggccggttcaccactgtcgagggaatgttgacggcaatgaaggaaaagctggagtcacaggcaccattcttttcgggtgatagcacactggagagggagaggaggacatttcaagccagattggacagattggcagcctcaactcgattggaagaaccatgcacgctgattttggatgatccggccgggaatagttttattaagagtttaacagccccattggatgatggacgacttaaaaaggaattttacacacgaaatcatgaacaaaatgatgagctgggtttgaatgatatgaaggtggaaaattacnnnnnnnnnnnnnnnnnnnnnnnnnnnnnnnnnnnnnnnnnnnnnnnn

SEQ ID NO: 1040 - DNA, 1422 bp, Artificial Sequence
  Description of Artificial Sequence: Synthetic polynucleotide
  modified_base (1)..(768): a, c, t, g, unknown or other
  modified_base (871)..(1422): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcgaacaataaaagtttggcgggcgacggacggtgtcctttgccgaacactcactggccatgcacattggataaatacggtggcactgaatgtggattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1041 - DNA, 780 bp, Artificial Sequence
  Description of Artificial Sequence: Synthetic polynucleotide
  modified_base (1)..(69): a, c, t, g, unknown or other
  modified_base (766)..(780): a, c, t, g, unknown or other
nnnnnnnnnnnnnnnnnnnnnnnnnnnnnnnnnnnnnnnnnnnnnnnnnnnnnnnnnnnnnnnnnnnnnaggcgcaagaaacaagccagatctgttcatgagcgttcaaaagtttcaaagaaattgcggaaaggaaaggcgaaactttaccataaaaaacgttattcggagaaggttcaaatgcgcaaattaatcaaagaacatgaagagaagaaacagaaaagcactgttgaagaaccaactgaaggcgctgttccaacttatcttcttgaccgtcagcaacaaactattggcaaagcattgtccagtgcaatcaagcaaaaacgcaaggagaaagctgcaaaatatcaagttccattgccaaaagtgaaagctgtgagcgatgccgaagcattcaaagtggttcagacaggcaaaacacgacggaaaggttggaagcgaatggtaacaaaagtgacatttgttggcgagacctttacgcgaaaaccagcaaaattcgagcgattcatccgcccaatggggcttcgttttaaaaaggctcatgtgacacatcccgaattacggaccacattttgtttgccaattgttggagtcaagaagaatccctcttcacaattatacacatcactcggcgtcataaccaaaggaacaataattgaggtgaatgtgagcgaattgggaatggtgacgcaaggaggcaaagtggtttgggccaaatatgcccaagtgaccaaccatccggagaatgacggttgcattaatgccnnnnnnnnnnnnnnn

SEQ ID NO: 1042 - DNA, 1035 bp, Artificial Sequence
  Description of Artificial Sequence: Synthetic polynucleotide
  modified_base (1)..(120): a, c, t, g, unknown or other
  modified_base (262)..(435): a, c, t, g, unknown or other
  modified_base (652)..(762): a, c, t, g, unknown or other
  modified_base (862)..(1035): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaatggacgaataattcagtactggttcgttggctggcatccccaataaatccattggatttgaacataattgagggaagatatgcgattagcccaaaattgccagccatcggtgggacggaggcaattggcatagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctacagaatgcttcacgattttgtttgccttaagaaaggagattcagtcgtccaaaatggggcaaattccgctgttggccgatacgttattcagatatgtcgaattttggggctcaaaagtcataacattgtgcggaatggaccagatgttgatagcctgaaaagagatttggagggacttggagccgacgcagtctatacagaagaggaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccaggaatgtctcaacaaccggttcagctgcccaccacctccctgatatttcaaaatgttgcggctcgaggcttttggatgtctcgatggtatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1043 - DNA, 2916 bp, Artificial Sequence
  Description of Artificial Sequence: Synthetic polynucleotide
  modified_base (1)..(3): a, c, t, g, unknown or other
  modified_base (99)..(99): a, c, t, g, unknown or other
  modified_base (163)..(861): a, c, t, g, unknown or other
  modified_base (1191)..(1191): a, c, t, g, unknown or other
  modified_base (1209)..(1209): a, c, t, g, unknown or other
  modified_base (1474)..(2016): a, c, t, g, unknown or other
  modified_base (2275)..(2277): a, c, t, g, unknown or other
  modified_base (2347)..(2349): a, c, t, g, unknown or other
  modified_base (2476)..(2916): a, c, t, g, unknown or other
nnntctgttggcgagctaccttgctattcgttaatccaagttgcaaatgatttggaatatccatcagaaggacaattgaaagaaaaatttgaacatggngatacgaaagcgaaaacagaaacgctgaaaaaattgatattgatgatacaatcaggtgaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattaattgtgaaagaatcggataataatgtcaaacttattgttttggatcgtttggttggtcttcgcgaaatactccccaatgacaaagttctccaagaacttgttatggacattttgcgtgtactttccacaactgattatgaagttcggcgcaaaatcctccaattggcattggaacttgtttcatctcgaaatgtgcacgaaatggtcatgtttttaaagaaggaaattgacaaaaccaacaatgatcaacaagaagacattgggcgttatcgacagcaattggtccggacattgcacagtgcaacgatcaaattccccgatgtngcccaacaaatattcccngttctaatggaatttctctctgaccaaagtgaaacagccgcaatggatgttttggtctttattcgtgaagccatccaccgaatgcctcatttacgtcaacatattttaagccaacttttggaagtttacccgaccatcagaaatgcatccattttccgttcggccctttggattttgggcgaatattccgaccaatcggaaataattacggtttttgaattgatcaaagaatcacttggagaattgccactttttgattcggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatattttcagcctgataaaacaattctattcacccaactttcaacacgagttgccgaagaccggacaaaccttttcgacctttctttgtcgcaagcacttggaaccgccccaaaaccaatcaaatttgattttgccacttccaaattgggcaaaataattcaattaactggattttcggacccggtctatgccgaagcatatgtgaatgtgaatcaatatgacatcgttttggacgtacttgtggtcaatcaaacgnnngatactctacaaaatttgtcattggaattatccaccgttggcgatttgaaattggtggacaaacctaccnnngtgactttggcccctcatgatttcacaaatataaaggccaccgtaaaagtatcatccaccgaaaatggcgtaattttttccacaattgcttatgatgttcgaggctcaacttccgaccgaaattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1044 - DNA, 1029 bp, Artificial Sequence
  Description of Artificial Sequence: Synthetic polynucleotide
  modified_base (1)..(117): a, c, t, g, unknown or other
  modified_base (234)..(234): a, c, t, g, unknown or other
  modified_base (277)..(279): a, c, t, g, unknown or other
  modified_base (391)..(456): a, c, t, g, unknown or other
  modified_base (667)..(1029): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggaatgattcttttgtccgaattgtcccgaaggcgcattcgttcagtgaacaaattgattaaagttggccgaagtgaatgcgttatagtgattcgcgtggaccaggataaagtntatattgatttgtcaaaaagacgagtctattcgaaggatttannncaatgcgaagaacgttttgcacgtgccaaagcaattaacagcattttgcgccatgttgccgaccaattgggctacacaaaaagcgaggaattggaacaactttacgaaaagnnnnnnnnnnnnnnnnnnnnnnnnnnnnnnnnnnnnnnnnnnnnnnnnnnnnnnnnnnnnnnnnnnttaagtgattcaactgttttcgatgaatgcgaaattgacgaaaaagtgaaaagtcaattgttgagcgaaattcacaaaaaattgacaccaaaagcactcaaaattcgttcggacattgaagtaagctgttttgcctatgacggagttgaggcggtgaagaaggcacttttggctgggaaacaatgctcaacggaggaaatgtccatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1045 - DNA, 1410 bp, Artificial Sequence; identical to SEQ ID NO: 527
  Description of Artificial Sequence: Synthetic polynucleotide
  modified_base (1)..(6): a, c, t, g, unknown or other
  modified_base (141)..(141): a, c, t, g, unknown or other
  modified_base (306)..(306): a, c, t, g, unknown or other
  modified_base (399)..(399): a, c, t, g, unknown or other
  modified_base (441)..(441): a, c, t, g, unknown or other
  modified_base (583)..(852): a, c, t, g, unknown or other
  modified_base (1263)..(1263): a, c, t, g, unknown or other
  modified_base (1393)..(1410): a, c, t, g, unknown or other

SEQ ID NO: 1046 - DNA, 1359 bp, Artificial Sequence
  Description of Artificial Sequence: Synthetic polynucleotide
  modified_base (1)..(363): a, c, t, g, unknown or other
  modified_base (432)..(432): a, c, t, g, unknown or other
  modified_base (595)..(1359): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttcgaattgccggcggttcgtccggaggatgcgcagtcgcagtggcaaccggcatcgcagatatngcaattggcagtgataccggcggctcagtgcgatacccagccgcattgaacggagttattggctttaaaccatcctatggccgtctgtccaggcatggacttgttcctttggccaattccatggacacaccttccatttttgcaaaatccatcgaagattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1047 - DNA, 462 bp, Artificial Sequence
  Description of Artificial Sequence: Synthetic polynucleotide
  modified_base (1)..(66): a, c, t, g, unknown or other
  modified_base (214)..(237): a, c, t, g, unknown or other
  modified_base (396)..(396): a, c, t, g, unknown or other
  modified_base (445)..(462): a, c, t, g, unknown or other
nnnnnnnnnnnnnnnnnnnnnnnnnnnnnnnnnnnnnnnnnnnnnnnnnnnnnnnnnnnnnnnnnngccacggccaattaccacgagaaagtcattgatcattatgaaaatccaaggaatgtcggatcattggataaaaatgatccaacagttgggactgggattgttggcgcaccagcatgtggcgatgttatgaaattgcaaatcaaggttnnnnnnnnnnnnnnnnnnnnnnnngccaaattcaaaacatttggctgtggttcagcaattgcaagttcatcattggccactgaatggatcaaagggcgcaatttggattatgccggcaagattaagaatcaagaaattgcgaaggaactctcacttccacccgtgaaattgcattgttcaagnttagcccaagatgcaattcaagcagcattgaatgactacaaaaagaaannnnnnnnnnnnnnnnnn

SEQ ID NO: 1048 - DNA, 579 bp, Artificial Sequence
  Description of Artificial Sequence: Synthetic polynucleotide
  modified_base (1)..(75): a, c, t, g, unknown or other
  modified_base (178)..(579): a, c, t, g, unknown or other
nnnnnnnnnnnnnnnnnnnnnnnnnnnnnnnnnnnnnnnnnnnnnnnnnnnnnnnnnnnnnnnnnnnnnnnnnnntttatttttttgtcagaatgttcaatgcccattgaatactgcgaatacagtggaaaatatgaaaaatgccagcaatggttggagaagaatttgcccgatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1049 - DNA, 492 bp, Artificial Sequence
  Description of Artificial Sequence: Synthetic polynucleotide
  modified_base (1)..(63): a, c, t, g, unknown or other
  modified_base (276)..(276): a, c, t, g, unknown or other
  modified_base (331)..(492): a, c, t, g, unknown or other
nnnnnnnnnnnnnnnnnnnnnnnnnnnnnnnnnnnnnnnnnnnnnnnnnnnnnnnnnnnnnnngcagcagcaccaacaacagataaagaagaatatgaagcactttgtcaacttgttaatccgattgcgcaaccaatggcaagtagaaaattggccaagaaaatctacaaattggtgaagaagtcggccaaggagaaaggcaatttgagacatggattggctgatgtgatgaaggcaatacggaagaaagagaagggcatcgttattctagcaggnaatgtttcgcctatcgatgtttacagccatattccggcattatgtgaagaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1050 - DNA, 2025 bp, Artificial Sequence
  Description of Artificial Sequence: Synthetic polynucleotide
  modified_base (1)..(174): a, c, t, g, unknown or other
  modified_base (265)..(687): a, c, t, g, unknown or other
  modified_base (937)..(1578): a, c, t, g, unknown or other
  modified_base (1716)..(1716): a, c, t, g, unknown or other
  modified_base (1822)..(2025): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacgaaacacaattggcaatattccggttcaatggtacgaggaatatggacatgttggctatgacgtgggcggtcagagaattgctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatataggttcactcaaaaaattagtttctaaatttaatcaaaattttaggcctccacccgaatatttattcaatgaagaggaaaggcgtaaatgggaagagaggaatgatgaatttgagaggccaaaattcattcctcaacgctacaattcctttcgggaggtgcccttttttgagaatttttacgaggaacggctggaacggtgcatggatttgcatttggcgccaaggcagaggaaaatgcgggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgtcctaatctacgatttggcacaaaatgagttgaaacgtaaaatatttccgggcacaaaatggctttcatgcatgacactgcatccagccggcgacaatttattcattggtggcctcgaccgcacattttcatgnttggacttggaattgggcacaaaaccatggaaaaagctgcgcaaccaccaatctggcatacgttccatcacctatcatcgacgatatcctttgctggccaccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1051 - DNA, 1362 bp, Artificial Sequence
  Description of Artificial Sequence: Synthetic polynucleotide
  modified_base (1)..(216): a, c, t, g, unknown or other
  modified_base (313)..(747): a, c, t, g, unknown or other
  modified_base (850)..(900): a, c, t, g, unknown or other
  modified_base (1146)..(1146): a, c, t, g, unknown or other
  modified_base (1264)..(1362): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatatccatgtctgagtttcgatgttttgccggatgcattaggcgataatcgtacgagatttccgatgaccgcttggttggccactggatcgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaaagattttcctatggcgcatggccgaaggtggcaaatggctaattgaccaacgcgccctttgcgaccatcagggttcggtggaagatttaggttggnnnnnnnnnnnnnnnnnnnnnnnnnnnnnnnnnnnnnnnnnnnnnnnnnnncgcctttgggatgttcgggcaccttccaaacaagcttgtgtttgcactgtccccaatgcgcatgaagcggatgtgaatgtgctcagttgggatggaagtgaccaattgattgtgtcgggcggcgatgatgccattctacgcgtttggtccattaaaactcttcagtacaaacaatcgatggcccaatttcgccatcatcaaaagccaattacatcggtggagtggagcccgcatgattatacattnttcatggcatccggtgaagatgaccaaacgacaatttgggatttggcgctggaagaagatgaaccgaccgcaaaacaacaattgcccccgcaactcctcttcattcatatgggccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1052 - DNA, 1422 bp, Artificial Sequence; identical to SEQ ID NO: 409
  Description of Artificial Sequence: Synthetic polynucleotide
  modified_base (1)..(3): a, c, t, g, unknown or other
  modified_base (156)..(156): a, c, t, g, unknown or other
  modified_base (354)..(354): a, c, t, g, unknown or other
  modified_base (457)..(795): a, c, t, g, unknown or other
  modified_base (1008)..(1008): a, c, t, g, unknown or other
  modified_base (1162)..(1422): a, c, t, g, unknown or other

SEQ ID NO: 1053 - DNA, 1377 bp, Artificial Sequence
  Description of Artificial Sequence: Synthetic polynucleotide
  modified_base (1)..(75): a, c, t, g, unknown or other
  modified_base (424)..(1083): a, c, t, g, unknown or other
  modified_base (1122)..(1122): a, c, t, g, unknown or other
  modified_base (1167)..(1167): a, c, t, g, unknown or other
  modified_base (1174)..(1174): a, c, t, g, unknown or other
  modified_base (1192)..(1377): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnccccgaattgcaatcattggttctggcccatccggcctttatgtttgcacccggctcctccaaaaagcccaatgccggattgacattttcgacaaggcccaggccccatttggactcatctattatggggttgcaccggatcattttgatatgaaaaaaagtatgaatagttttgagcgaatgttccaagagaatcaagaacgggtccaactttttgggaatgtggatattaacaaggatttgagctacgatgaattatgcaccgaatatgaggcagtcattctcgcttacggagccagcaaagccagacgattgggattggccaatgaaaatgtgggcaattgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtttacgccactggatggtgttcacatgcagcgagnggcctaattgcagaaagtcaacaacaagcctattcggtggccgancaaattnttgaagattgggaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1054 - DNA, 2370 bp, Artificial Sequence
  Description of Artificial Sequence: Synthetic polynucleotide
  modified_base (1)..(159): a, c, t, g, unknown or other
  modified_base (535)..(537): a, c, t, g, unknown or other
  modified_base (580)..(996): a, c, t, g, unknown or other
  modified_base (1038)..(1038): a, c, t, g, unknown or other
  modified_base (1156)..(1157): a, c, t, g, unknown or other
  modified_base (1159)..(1159): a, c, t, g, unknown or other
  modified_base (1161)..(1161): a, c, t, g, unknown or other
  modified_base (1365)..(1365): a, c, t, g, unknown or other
  modified_base (1869)..(1869): a, c, t, g, unknown or other
  modified_base (1984)..(2370): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgaattcgggcacgtgattatcgcagtgaagttcgtctgaaaaaaggaccatgcatcacgcccactttgggttgcaccggatggacatattttcttggaatcattttcgcccgtctacaaacatgctgccgattttctaattgcaatttcggagccaatttgtcgtccggaacatattcacgaatatcaattgaccgcatattccctctatgccgccgtttcaattggccttcaaacaaatgatattattgaatatttggatcgattatgcaaaacaacactgcctgaggccatcaaaaaattcatagaagtttgcactctgagctatggaaaagtgaaattggtgctgaaaaggaacaaatatttcgttgaannncgtcattccgatgtgctgcaaaaattattgaaggacaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgtttgggaatagtcgagcacgttccggtgtaatctgnttgccatgtggtgccggcaaaacattggttggggtcacggcggccacaacaattaacaaacgatgtttggtgctggcaaccagcaatgttagtgtggagcaatggcgccaacaatttnngntntggtccaccattcaagacaaccaaatcattcgattcacccgtgatgcacgagacattgttccaagtgggtcggatgccaacaaaccgatggtttgcattagcagctattcaatggtcgcatacaccggcaaaagggcctacatggcggaggaagcaatgcgatacattgaaagcttggagtggggattgcttcttttggatgangttcatacaattccggcaaaaatgttccgtcgggtgttgaccatcgtccgagcacattgcaaattgggcctcaccgcaacattggtcagagaggatgacaaaattacggatttgaatttcctaattggaccaaaaatttacgaagccaattggatggaactacaaaaggccggtcatattgcaaaagtgcaatgcgctgaagtttggtgcccaatgacagctgaattttttgactattacctcaaatcaaacataaatcgcaaattattgttggccgtcacaaacccgaataaattccgcgtttgtcaatatttaattcgcttccatgaacgccgaaatgataaaattatcgtcttctccgacaatgtttttgccctccaaaaatttgcaatccaaatgaataaaccattcctttttggacaaacttcccaacccgaaaggatgaaaattttgcaaaatttccaatacaatccccgagtgaataccattttttgtttcaaagtnttgccgacacatcattgattgcccgaggccaatgtgctcatccaaatcagtgcgcacggtggttctcggcgtcaggaagcacaaaggctgggcagaattttgcgcgcaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1055 - DNA, 3699 bp, Artificial Sequence; identical to SEQ ID NO: 611
  Description of Artificial Sequence: Synthetic polynucleotide
  modified_base (1)..(3): a, c, t, g, unknown or other
  modified_base (48)..(48): a, c, t, g, unknown or other
  modified_base (121)..(183): a, c, t, g, unknown or other
  modified_base (309)..(310): a, c, t, g, unknown or other
  modified_base (313)..(318): a, c, t, g, unknown or other
  modified_base (320)..(321): a, c, t, g, unknown or other
  modified_base (324)..(324): a, c, t, g, unknown or other
  modified_base (326)..(326): a, c, t, g, unknown or other
  modified_base (328)..(328): a, c, t, g, unknown or other
  modified_base (331)..(331): a, c, t, g, unknown or other
  modified_base (333)..(336): a, c, t, g, unknown or other
  modified_base (338)..(338): a, c, t, g, unknown or other
  modified_base (340)..(340): a, c, t, g, unknown or other
  modified_base (345)..(345): a, c, t, g, unknown or other
  modified_base (350)..(350): a, c, t, g, unknown or other
  modified_base (352)..(354): a, c, t, g, unknown or other
  modified_base (358)..(360): a, c, t, g, unknown or other
  modified_base (376)..(376): a, c, t, g, unknown or other
  modified_base (378)..(378): a, c, t, g, unknown or other
  modified_base (381)..(381): a, c, t, g, unknown or other
  modified_base (392)..(393): a, c, t, g, unknown or other
  modified_base (396)..(396): a, c, t, g, unknown or other
  modified_base (401)..(401): a, c, t, g, unknown or other
  modified_base (410)..(412): a, c, t, g, unknown or other
  modified_base (414)..(415): a, c, t, g, unknown or other
  modified_base (418)..(418): a, c, t, g, unknown or other
  modified_base (421)..(425): a, c, t, g, unknown or other
  modified_base (427)..(430): a, c, t, g, unknown or other
  modified_base (432)..(432): a, c, t, g, unknown or other
  modified_base (435)..(435): a, c, t, g, unknown or other
  modified_base (438)..(440): a, c, t, g, unknown or other
  modified_base (442)..(442): a, c, t, g, unknown or other
  modified_base (444)..(449): a, c, t, g, unknown or other
  modified_base (452)..(452): a, c, t, g, unknown or other
  modified_base (456)..(457): a, c, t, g, unknown or other
  modified_base (459)..(464): a, c, t, g, unknown or other
  modified_base (468)..(468): a, c, t, g, unknown or other
  modified_base (471)..(471): a, c, t, g, unknown or other
  modified_base (474)..(475): a, c, t, g, unknown or other
  modified_base (479)..(481): a, c, t, g, unknown or other
  modified_base (483)..(483): a, c, t, g, unknown or other
  modified_base (486)..(487): a, c, t, g, unknown or other
  modified_base (498)..(498): a, c, t, g, unknown or other
  modified_base (564)..(564): a, c, t, g, unknown or other
  modified_base (627)..(627): a, c, t, g, unknown or other
  modified_base (910)..(1677): a, c, t, g, unknown or other
  modified_base (1761)..(1761): a, c, t, g, unknown or other
  modified_base (1995)..(1995): a, c, t, g, unknown or other
  modified_base (2031)..(2031): a, c, t, g, unknown or other
  modified_base (2040)..(2040): a, c, t, g, unknown or other
  modified_base (2256)..(2256): a, c, t, g, unknown or other
  modified_base (2446)..(3198): a, c, t, g, unknown or other
  modified_base (3423)..(3423): a, c, t, g, unknown or other
  modified_base (3502)..(3699): a, c, t, g, unknown or other

SEQ ID NO: 1056 - DNA, 834 bp, Artificial Sequence
  Description of Artificial Sequence: Synthetic polynucleotide
  modified_base (1)..(585): a, c, t, g, unknown or other
  modified_base (820)..(834): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcagttggaaacggatgacagtcttttgatcaaaaaagcacaaggagcattggagaaatatgggcacaatgcggtcattggaaatttgttacaaacccggaagaagcatgtcatcttcgtttacccaaaccaaagaactgttgaatccatcgatttagcaccaattggccaaggaatggaaatcgagcagaaaattgtggagaaacttgttgaacagcacggagaatacattnnnnnnnnnnnnnnn

SEQ ID NO: 1057 - DNA, 819 bp, Artificial Sequence
  Description of Artificial Sequence: Synthetic polynucleotide
  modified_base (1)..(321): a, c, t, g, unknown or other
  modified_base (562)..(819): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacaaattgaactgtacagccatctgccggttatgcaacaaattgttggtgccctccaacaatggaatttctccgtttgttccacattcattttggacaccagtttttgcctggacccggacaaattcatttcggccgccctcaccaccctctccacgttggtttcccaaacaacgccttttgtcagtgttctcagcaaaatggatttgttgggcaaagaagacagggacattgtggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1058 - DNA, 327 bp, Artificial Sequence
  Description of Artificial Sequence: Synthetic polynucleotide
  modified_base (1)..(198): a, c, t, g, unknown or other
  modified_base (264)..(264): a, c, t, g, unknown or other
  modified_base (295)..(327): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacggtgtccgaaatgttctcatgagaaggcatatttccagcaaattcaaaccaggagtgcaatngagccaatgacgattttttatcgctgtgccnnnnnnnnnnnnnnnnnnnnnnnnnnnnnnnnn

SEQ ID NO: 1059 - DNA, 1344 bp, Artificial Sequence
  Description of Artificial Sequence: Synthetic polynucleotide
  modified_base (1)..(645): a, c, t, g, unknown or other
  modified_base (715)..(717): a, c, t, g, unknown or other
  modified_base (861)..(861): a, c, t, g, unknown or other
  modified_base (952)..(954): a, c, t, g, unknown or other
  modified_base (1051)..(1344): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggtggatccgatcaattgggaaatttgaaggctggatttgaacatattcgcgaattgagcgatcgtnnncttccacttggaattttttttcctttactgactgatagaaatgggaataaattgggcaaatcttccaatgacacgggcgtttggctaaatccaaaaaagtcttcaccatttgcattttatcaatatttgcgacaattgcatatngacattgccgaacaatttttgattcaattttccatacgtccattcaaagaaatagaggaaatcatcaaccaccatcgaaataatctgggannntggatagcccaaacacatttggctgatgaaattactttacttgtacacggaaatgagagtttggaattggccaaaagatgttcacatttattattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1060 - DNA, 525 bp, Artificial Sequence
  Description of Artificial Sequence: Synthetic polynucleotide
  modified_base (1)..(216): a, c, t, g, unknown or other
  modified_base (433)..(525): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgatgtacatggctggcaacaccatatcaatttttcctattatgatggtcgtaatgatggcttggcgaccaattaaggcacttctttcggtgaatgccgccttcaaaccattagaacaagaacatcttggctcgctgatcctccacaaaatcatcttcgtcattggcaattgtggggcaattgggctagctgtttataaatgtcatacaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1061 - DNA, 645 bp, Artificial Sequence
  Description of Artificial Sequence: Synthetic polynucleotide
  modified_base (1)..(435): a, c, t, g, unknown or other
  modified_base (640)..(645): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaatggaaaaattcgacaaaaatcaaagaccgattgtttgattttcaacatcccaacacttctggaattcatcaccaggaccattacgctggagccgggggatttggtgctgacgggcacaccggcgggcgttggtcgatgcgacaaaggggacaaattggaaattggaattagtggaatatgcaaagcctcattcaaaattnnnnnn

SEQ ID NO: 1062 - DNA, 879 bp, Artificial Sequence
  Description of Artificial Sequence: Synthetic polynucleotide
  modified_base (292)..(879): a, c, t, g, unknown or other
atgcttcgccgacaagttcgtgaacgtcgagaatatttgtaccggaaaaatttggaagcaaagcaaagagctacgcaggaacgaagaagccgggtgaaaaatgcattggatacaagtaatatgctgccaactgacttgcgaaagaatgccgtcgaaatggtcggcgatttggcctggggtgaacaagttgacaccgtggacgacgaataccgctgggccggatgtgaagatccgagcattgtggtcacaacaagtcgagatccatcatctcggttgaaaatgtttgcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1063 - DNA, 459 bp, Artificial Sequence
  Description of Artificial Sequence: Synthetic polynucleotide
  modified_base (1)..(81): a, c, t, g, unknown or other
  modified_base (325)..(459): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnngaaataacatttttcaatgagtcactgaacgaattgaggaatgtatcaagtaaattcggccgttgtcaagtgaccctcgagtccataaacaaggatgagaagaataaaccggcgatgattccattatccgaatcggtgtacattaatggaaaagttttggacccagacaaatatttagtcgagattggaaccggctattttgtgaagatgaatcgcaaaaatgctttggaatactttaaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1064 - DNA, 1170 bp, Artificial Sequence
  Description of Artificial Sequence: Synthetic polynucleotide
  modified_base (1)..(879): a, c, t, g, unknown or other
  modified_base (1051)..(1170): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttacaaaggctttctgccattttattgaaaaaacaaattgatgaaattagcagaaaatatacggggaatagaaaattgcaggttgcttcgttggatcgggcagagaaaattcgaacatataattttaaagatgatcgaattacggaccatcggcttaaggttaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

NO:1; and (b) a second nucleotide sequence comprising the reverse complement of the first nucleotide sequence, wherein the polynucleotide is expressed to produce a dsRNA that functions upon being taken up by said nematode population to inhibit growth or reproduction of said nematode population.

14. The method of claim 13, wherein said nematode is *Pratylenchus scribneri, Pratylenchus hexincisus, Pratylenchus brachyurus, Pratylenchus zeae, Pratylenchus penetrans, Pratylenchus neglectus* or *Pratylenchus crenatus.*

15. A method for reducing the number of root lesion nematodes productively feeding in root tissue of a host plant, said method comprising providing a transgenic host plant for said root lesion nematodes to feed on, said transgenic host plant expressing a polynucleotide comprising (a) a first nucleotide sequence comprising at least 40 contiguous nucleotides of SEQ ID NO:1; and (b) a second nucleotide sequence comprising the reverse complement of the first nucleotide sequence, wherein said polynucleotide is expressed to produce a dsRNA that functions upon being taken up by said root lesion nematodes to inhibit expression of a top-1 sequence within said root lesion nematodes and results in a decrease in the number of productively feeding root lesion nematodes, relative to the number of feeding root lesion nematodes established on a non-transgenic host plant.

16. A method of controlling infestation of a *Pratylenchus* nematode pest in a plant, said method comprising providing in a diet of said nematode pest a dsRNA comprising:
   a) a sense nucleotide sequence comprising at least 40 contiguous nucleotides of SEQ ID NO:1; and
   b) an antisense nucleotide sequence comprising the complement of the sense nucleotide sequence.

17. The method of claim 16, wherein said diet comprises a plant cell transformed to express said sense nucleotide sequence and said antisense nucleotide sequence.

18. A method for improving the yield of a crop produced from a crop plant subjected to *Pratylenchus* nematode infestation, said method comprising the steps of,
   a) introducing the transformation vector of claim 1 into said crop plant;
   b) cultivating the crop plant to allow expression of said polynucleotide;
   wherein expression of said polynucleotide inhibits *Pratylenchus* nematode, growth and reproduction, thereby improving the yield of the crop.

19. The method of claim 18, wherein said crop plant is selected from the group consisting of corn, wheat, barley, rye, rice, potato, tomato, cucumber, pepper, clover, legume, soybean, pea, alfalfa, sugar cane, sugar beet, tobacco, carrot, cotton, canola, sunflower, safflower, sorghum, strawberry, banana, and ornamental.

20. The commodity product of claim 10, wherein said commodity product is food or feed is defined as oil, meal, protein, starch, flour or silage.

21. The transformation vector of claim 1, further comprising a spacer nucleotide sequence between said first nucleotide sequence and said second nucleotide sequence.

* * * * *